US011324818B2

(12) United States Patent
Houghton et al.

(10) Patent No.: US 11,324,818 B2
(45) Date of Patent: May 10, 2022

(54) HEPATITIS C VIRUS IMMUNOGENIC COMPOSITIONS AND METHODS OF USE THEREOF

(71) Applicant: The Governors of the University of Alberta, Edmonton (CA)

(72) Inventors: Michael Houghton, Danville, CA (US); Abdolamir Landi, Edmonton (CA); Michael Logan, Edmonton (CA); John L. Law, Edmonton (CA); Darren Hockman, Edmonton (CA); Chao Chen, Edmonton (CA)

(73) Assignee: The Governors of the University of Alberta, Edmonton (CA)

( * ) Notice: Subject to any disclaimer, the term of this patent is extended or adjusted under 35 U.S.C. 154(b) by 309 days.

(21) Appl. No.: 16/334,683

(22) PCT Filed: Sep. 21, 2017

(86) PCT No.: PCT/IB2017/055714
§ 371 (c)(1),
(2) Date: Mar. 19, 2019

(87) PCT Pub. No.: WO2018/055535
PCT Pub. Date: Mar. 29, 2018

(65) Prior Publication Data

US 2019/0209677 A1 Jul. 11, 2019

Related U.S. Application Data

(60) Provisional application No. 62/397,763, filed on Sep. 21, 2016.

(51) Int. Cl.

| | |
|---|---|
| ***A61K 39/29*** | (2006.01) |
| ***A61K 39/12*** | (2006.01) |
| ***A61K 39/00*** | (2006.01) |

(52) U.S. Cl.
CPC .............. *A61K 39/29* (2013.01); *A61K 39/12* (2013.01); *A61K 2039/53* (2013.01); *A61K 2039/54* (2013.01); *A61K 2039/55544* (2013.01); *A61K 2039/70* (2013.01); *C12N 2710/10034* (2013.01); *C12N 2710/10043* (2013.01); *C12N 2710/24134* (2013.01); *C12N 2710/24143* (2013.01); *C12N 2770/24234* (2013.01)

(58) Field of Classification Search
None
See application file for complete search history.

(56) References Cited

U.S. PATENT DOCUMENTS

| | | | |
|---|---|---|---|
| 5,709,879 | A | 1/1998 | Barchfield et al. |
| 5,709,995 | A | 1/1998 | Chisari et al. |
| 6,534,064 | B1 | 3/2003 | O'Hagan et al. |
| 6,555,114 | B1 | 4/2003 | Leroux-Roels et al. |
| 6,602,705 | B1 | 8/2003 | Barnett et al. |
| 6,613,333 | B1 | 9/2003 | Leroux-Roels et al. |
| 6,635,257 | B1 | 10/2003 | Depla et al. |
| 6,689,368 | B1 | 2/2004 | Leroux-Roels et al. |
| 6,740,323 | B1 | 5/2004 | Selby et al. |
| 6,986,892 | B1 | 1/2006 | Coit et al. |
| 7,220,420 | B2 | 5/2007 | Chisari et al. |
| 7,238,356 | B2 | 7/2007 | Bosman et al. |
| 7,270,820 | B2 | 9/2007 | Diepolder et al. |
| 7,378,234 | B2 | 5/2008 | Buschle et al. |
| 7,439,058 | B2 | 10/2008 | Selby et al. |
| 7,449,566 | B2 | 11/2008 | Coit et al. |
| 7,491,808 | B2 | 2/2009 | Chien et al. |
| 7,604,802 | B2 | 10/2009 | O'Hagan et al. |
| 7,731,967 | B2 | 6/2010 | O'Hagan et al. |
| 7,888,004 | B2 | 2/2011 | Coit et al. |
| 8,071,561 | B2 | 12/2011 | Sallberg et al. |
| 8,124,747 | B2 | 2/2012 | Sablon et al. |
| 8,158,602 | B2 | 4/2012 | Sallberg |
| 8,163,547 | B2 | 4/2012 | Sallberg |
| 8,168,418 | B2 | 5/2012 | Barnett et al. |
| 8,178,086 | B2 | 5/2012 | Houghton et al. |

(Continued)

FOREIGN PATENT DOCUMENTS

| | | |
|---|---|---|
| CA | 2901346 | 5/2014 |
| WO | WO 2005/113837 | 12/2005 |

(Continued)

OTHER PUBLICATIONS

Folgori, et al.; "A T-cell HCV vaccine eliciting effective immunity against heterologous virus challenge in chimpanzees"; Nature Medicine; vol. 12, No. 2, pp. 190-197 (Feb. 2006).
Fournillier, et al.; "Expression of Noncovalent Hepatitis C Virus Envelope E1-E2 Complexes Is Not Required for the Induction of Antibodies with Neutralizing Properties following DNA Immunization"; Journal of Virology; vol. 73, No. 9, pp. 7497-7504 (Sep. 1999).
Gededzha, et al.; "Prediction of T-cell epitopes of hepatitis C virus genotype 5a"; Virology Journal; No. 11, No. 187, 13 pages (2014).
Mikkelsen, et al.; "Current Status of a Hepatitis C Vaccine: Encouraging Results but Significant Challenges Ahead"; Current Infectious Disease Reports; vol. 9, pp. 94-101 (2007).

(Continued)

*Primary Examiner* — Michelle S Horning
(74) *Attorney, Agent, or Firm* — Bozicevic Field & Francis, LLP; Paula A. Borden

(57) ABSTRACT

The present disclosure provides an immunogenic composition comprising: a) a hepatitis C virus (HCV) heterodimeric polypeptide that includes HCV E1 and E2 polypeptides; b) a T-cell epitope polypeptide comprising a T-cell epitope present in an HCV protein other than E1 and E2; and c) a pharmaceutically acceptable excipient. The present disclosure provides a method of inducing an immune response, in an individual, to an HCV polypeptide. The present disclosure provides an immunogenic composition comprising: a) a polypeptide that comprises one or more T-cell epitopes present in an HCV protein other than E1 and E2; and b) a pharmaceutically acceptable excipient.

16 Claims, 49 Drawing Sheets

Specification includes a Sequence Listing.

(56) References Cited

U.S. PATENT DOCUMENTS

| | | | | |
|---|---|---|---|---|
| 8,216,590 | B2 | 7/2012 | Houghton et al. | |
| 8,258,275 | B2 | 9/2012 | Sällberg et al. | |
| 8,388,980 | B2 | 3/2013 | Duke et al. | |
| 8,445,663 | B2 | 5/2013 | Sallberg et al. | |
| 8,460,672 | B1 | 6/2013 | Yusim et al. | |
| 8,529,906 | B2 | 9/2013 | O'Hagan et al. | |
| 8,669,091 | B2 | 3/2014 | Gentschev et al. | |
| 8,728,489 | B2 | 5/2014 | Apelian et al. | |
| 8,784,837 | B2 | 7/2014 | Buschle et al. | |
| 8,821,892 | B2 | 9/2014 | Duke et al. | |
| 8,883,169 | B2 | 11/2014 | Sällberg et al. | |
| 9,261,510 | B2 | 2/2016 | Scholz et al. | |
| 10,300,131 | B2 * | 5/2019 | Houghton | A61K 39/29 |
| 2018/0169219 | A1 * | 6/2018 | Houghton | A61K 39/29 |

FOREIGN PATENT DOCUMENTS

| | | |
|---|---|---|
| WO | WO 2007/081848 | 7/2007 |
| WO | WO 2015/132617 | 9/2015 |
| WO | WO 2017/006182 | 1/2017 |

OTHER PUBLICATIONS

Law, et al.; "Progress towards a hepatitis C virus vaccine"; Emerging Microbes and Infections; 6 pages (Oct. 9, 2013).

Gededzha, et al.; "Prediction of T-cell epitopes of hepatitis C virus genotype 5a"; VirologyJournal; vol. 11, No. 187, 13 pages (2014).

Seong, et al.; "Immunogenicity of the E1E2 proteins of hepatitis C virus expressed by recombinant adenoviruses"; Vaccine; vol. 19, pp. 2955-2964 (2001).

Sominskaya, et al.; "Comparative Immunogenicity in Rabbits of the Polypeptides Encoded by the 5' Terminus of Hepatitis C virus RNA"; Journal of Immunology Research; vol. 2015, 14 pages (Sep. 29, 2015).

Vajdy, et al.; "Hepatitis C virus polyprotein vaccine formulations capable of inducing broad antibody and cellular immune responses"; Journal of General Virology; vol. 87, pp. 2253-2262 (2006).

* cited by examiner

| Group | Sequence | 640–750 |
|---|---|---|
| | | 640 650 660 670 680 690 700 710 720 730 740 750 |
| | Consensus | YVGGVEHRLXAACNWTRGERCDLDDRDRSELSPLLLSTTQWQVLPCSFTTLPALSTGLIHLHQNIVDVQYLYGVGSSXVSWAIKWEYVILLFLLLADARICXCLWMMLLISQAEA |
| | | E2 protein peptide |
| 1A | AVI1a129 | YLGGVEHRLEAACNWTRGERCDLEDRDRSELSPLLLSTTQWQVLPCSFTTLPALSTGLIHLHQNIVDVQYLYGVGSSVASWAIKWDYVVLLFLLLADARICSCLWMMLLISQAEA |
| 1A | NP_671491(H77) | YVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEA |
| 1A | EU155269 | YVGGVEHRLEVACNWTRGERCDLDDRDRSELSPLLLSTTQWQVLPCSFTTLPALTTGLIHLHQNIVDVQYLYGVGSSIVSWAIKWEYVILLFLLLADARICSCLWMMLLISQAEA |
| 1A | EU781810 | YVGGVEHRLEVACNWTRGERCDLDDRDRSELSPLLLSTTQWQVLPCSFTTLPALTTGLIHLHQNIVDVQYLYGVGSSLVSWAIKWEYVILLFLLLADARICSCLWMMLLISQAEA |
| 1A | EU781771 | YVGGVEHRLQAACNWTRGERCDLDDRDRSELSPLLLSTTQWQVLPCSFTTLPALTTGLIHLHQNIVDVQYLYGVGSSIVSWAIKWEYVILLFLLLADARICSCLWMMLLISQAEA |
| 1A | AB520610 | YVGGVEHRLEVACNWTRGERCDLDDRDRSELSPLLLSTTQWQVLPCSFTTLPALTTGLIHLHQNIVDVQYLYGVGSSIVSWAIKWEYVILLFLLLADARICSCLWMMLLISQAEA |
| 1A | EU781752 | YVGGVEHRLVAACNWTYGERCNLDDRDRSELSPLLLSTTQWQVLPCSFTTLPALTTGLIHLHQNIVDVQYLYGVGSSIVSWAIKWEYVILLFLLLADARICSCLWMMLLISQAEA |
| 1A | EU781759 | YVGGVEHRLEAACNWTRGERCDLDDRDRSELSPLLLSTTQWQVLPCSFTTLPALTTGLIHLHQNIVDVQYLYGVGSSIVSWAIKWEYVILLFLLLADARICSCLWMMLLISQAEA |
| 1A | EF407439 | YVGGVEHRLEAACNWTRGERCNLDDRDRSELSPLLLSTTQWQVLPCSFTTLPALTTGLIHLHQNIVDVQYLYGVGSSIVSWAIKWEYVILLFLLLADARVCSCLWMMLLISQVEA |
| 1A | EF407427 | YVGGVEHRLDVACNWTRGERCNLDDRDRSELSPLLLSTTQWQVLPCSFTTLPALSTGLIHLHQNIVDVQYLYGVGSSIVSWAIKWEYVILLFLLLADARICSCLWMMLLISQAEA |
| 1A | EU362905 | YVGGVEHRLDVACNWTRGERCNLDDRDRSELSPLLLSTTQWQVLPCSFTTLPALSTGLIHLHQNIVDVQYLYGVGSSIVSWAIKWEYVILLFLLLADARICSCLWMMLLISQAEA |
| 1A | EF407413 | YVGGVEHRLDVACNWTRGERCNLDDRDRSELSPLLLSTTQWQVLPCSFTTLPALSTGLIHLHQNIVDVQYLYGVGSSIVSWAIKWEYVILLFLLLADARICSCLWMMLLISQAEA |
| 1A | EU781808 | YVGGIEHRLEVACNWTRGERCNLDDRDRSELSPLLLTTTQWQVLPCSFTTLPALTTGLIHLHQNVVDVQYLYGVGSSIVSWAIKWEYVILLFLLLADARICSCLWMMLLISQAEA |
| 1A | EU781790 | YVGGVEHRLEVACNWTRGERCNLDDRDRSELSPLLLSTTQWQVLPCSFTTLPALTTGLIHLHQNIVDVQYLYGVGSSIVSWAVKWEYVILLFLLLADARICSCLWMMLLISQAEA |
| 1B | AJ238799(Con1) | YVGGVEHRLEAACNWTRGERCNLEDRDRSELSPLLLSTTEWQVLPCSFTTLPALSTGLIHLHQNVVDVQYLYGIGSAVVSFAIKWEYVLLLFLLLADARVCACLWMMLLIAQAEA |
| 1B | AAK97744 | YVGGVEHRLDAACNWTRGERCNLEDRDRLELSPLLLSTTEWQVLPCSFTTLPALSTGLIHLHQNIVDVQYLYGIGSAVVSFAIKWDYIVILFLLLADARVCACLWMMLLIAQAEA |
| 1B | AF139594 | YVGGVEHRLNAACNWTRGERCNLDDRDRSELSPLLLSTTEWQVLPCSFTTLPALSTGLIHLHQNIVDVQYLYGIGSAVVSFAIKWEYVVLLFLLLADARVCACLWMMLLIAQAEA |
| 1B | AF176573 | YVGGVEHRLNAACNWTRGERCDLEDRDRSELSPLLLSTTEWQVLPCSFTTLPALSTGLIHLHQNIVDVQYLYGIGSAVIPFAIKWEYVLLLFLLLADARVCACLWMMLLIAQAEA |
| 1B | BAA19625 | YVGGIEHRLDAACNWTRGERCDLEDRDRSELSPLLLSTTEWQILPCSFTTLPALSTGLIHLHRNIVDVQYLYGIGSAVVSFAIKWEYVLLLFLLLADARVCACLWMMLLIAQAEA |
| 1B | BAA25076 | YVGGVEHRLDAACNWTRGERCDLEDRDRAELSPLLLSTTEWQILPCSYTTLPALSTGLIHLHQNIVDIQYLYGIGSAVVSIAIKWEYVVLLFLLLADARVCACLWMMLLIAQAEA |
| 1B | BAC54896 | YVGGIEHRLDAACNWTRGERCDLEDRDRSELSPLLLSTTEWQILPCSFTTLPALSTGLIHLHRNIVDVQYLYGIGSAVVSFAIKWEYILLLFLLLADARVCACLWMMLLIAQAEA |
| 1B | BAD91386 | YVGGVEHRLDAACNWTRGERCNVEDRDRSELSPLLLSTTEWQILPCSFTTLPALSTGLIHLHQNIVDVQYLYGVGSVVVSVVIRWEYVVLLFLLLADARVCACLWMMLLIAQAEA |
| 1B | BAF46764 | YVGGVEHRLTAACNWTRGERCDLEDRDRSELSPLLLSTTEWQIMPCSFTTLPALSTGLIHLHQNIVDIQYLYGIGSAAVSFAIRWEYVLLLFLLLADARVCACLWMMLLIAQAEA |
| 1B | BAG30950 | YVGGVEHRLTAACNWTRGERCDLEDRDRSELSPLLLSTTEWQIMPCSFTTLPALSTGLIHLHQNIVDIQYLYGIGSAAVSFAIRWEYVLLLFLLLADARVCACLWMMLLIAQAEA |
| 1B | CAB41951 | YVGGIEHRLSAACNWTRGERCDLEDRDRSELSPLLLSTTEWQILPCSFTTLPALSTGLIHLHQNTVDVQYLYGVGSVLVSFAIKWEYILLFFLLLADARVCACLWMMLLIAQAEA |
| 1C | AAK95832 | FVGGIEHRLTAACNWTRGERCDLDDRDRAELSPLLLSTTQWQVLPCSFTTLPALSTGLIHLHQNIVDVQYLYGLSSVVTSWAIRWEYVVLLFLLLADARICACLWMMLLISQVEA |
| 1C | AAT69968 | FVGGVEHRLDAACNWTRGERCDLDDRDRAELSPLLLSTTQWQVLPCSFTTLPALSTGLIHLHQNIVDVQYLYGLSSAVTSWVIKWEYVVLLFLLLADARICACLWMMLLISQVEA |
| 1C | BAA03581 | FVGGVEHRLDAACNWTRGERCDLDDRDRAELSPLLLSTTQWQVLPCSFTTLPALSTGLIHLHQNIVDVQYLYGLSSAVTSWVIKWEYVVLLFLLLADARICACLWMMLLISQVEA |

FIG. 1C

```
                   270       280       290       300       310       320       330       340
Consensus          HIDMVVMSATLCSALYVGDLCGGVMLAAQXFIVSPQRHWFVQECNCSIYPGTITGHRMAWDMMMNWSPTATMILAYAMRVPEVIIDI
                                                                E1
   AB047639 (JFH1) HIDMVVMSATFCSALYVGDLCGGVMLAAQVFIVSPQYHWFVQECNCSIYPGTITGHRMAWDMMMNWSPTATMILAYVMRVPEVIIDI
   AB047645        HIDMVVMSATLCSALYVGDLCGGVMLAAQMFIISPQHHWFVQECNCSIYPGTITGHRMAWDMMMNWSPTTTMILAYVMRVPEVIIDI
   AF238482        HIDMVVMSATLCSALYVGDLCGGVVLAAQLFIVSPRRHWFVQECNCSIYPGAITGHRMAWDMMMNWSPTTTMVLAYAMRVPEVIIDI
2A AF169005        HIDMVVMSATLCSALYVGDLCGGVMLAAQMFIVSPQHHHFVQECNCSIYPGAITGHRMAWDMMMNWSPTATMILAYAMRVPEVIIDI
   AY746460        HIDIVVMSATLCSALYVGDLCGGVMLAAQMFVVSPEHHWFVQECNCSIYPGTITGHRMAWDMMMNWSPTATMILAYAMRVPEVIIDI
   HPCPOLP         HIDMVVMSATLCSALYVGDLCGGVMLAAQMFIVSPQHHWFVQDCNCSIYPGTITGHRMAWDMMMNWSPTATMILAYAMRVPEVIIDI
   NC_009823       HIDMVVMSATLCSALYVGDLCGGVMLAAQMFIVSPQHHWFVQDCNCSIYPGTITGHRMAWDMMMNWSPTATMILAYAMRVPEVIIDI

   HPCJ8G HC-J8    HVDMIVMAATACSALYVGDVCGAVMILSQAFMVSPQRHNFTQECNCSIYQGHITGHRMAWDMMLSWSPTLTMILAYAARVPELVLEI
   AY232730        HVDVIVVAATVCSALYVGDVCGAVMIASQALIVSPARHNFTQECNCSIYQGRITGHHMAWDMMLNWSPTITMILAYAARIPELVLEV
2B AY232747        HVDVIVMAATVCSALYVGDICGAVMIVSQAFIISPERHNFTQECNCSMYQGHITGHRMAWDMMLNWSPTLTMILAYAARVPELVLEV
   AB030907        HVDVIVMAATVCSALYVGDVCGAVMIVSQALIVSPERHNFTQECNCSIYQGHITGQRMAWDMMLNWSPTLTMILAYAARVPELVLEI
   DQ430817        HVDMIVMAATVCSALYVGDVCGAVMIVSQAFIMS?ERHNFTQECNCSIYQGHITGHRMAWDMMLGWSPTLTMILAYAARVPE?VLEV
                   350       360       370       380       390       400       410       420       430
Consensus          IFGAHWGVMFGLAYFSMQGAWAKVIVILLLXAGVDARTHTVGGSXGRTTSGXAGLFSSGPKQNIQLINTNGSWHINRTALNCNDSLQ
                                   E1                                      E2
   AB047639 (JFH1) VSGAHWGVMFGLAYFSMQGAWAKVIVILLLAAGVDAGTTTVGGAVARSTNVIAGVFSHGPQQNIQLINTNGSWHINRTALNCNDSLN
   AB047645        IGGAHWGVMFGLAYFSMQGAWAKVVVILLLAAGVDAHTRT-GSSVGYATSGIVGLFTSGPKQNIQLINTNGSWHINRTALNCNDSLN
   AF238482        ISGAHWGVMFGLAYFSMQGAWAKVAVILLLTAGVEARTHTTGSVAGRTTSGFAGIFTSGPKQNIQLINTNGSWHINRTALNCNDSLN
2A AF169005        ISGAHWGVMFGLAYFSMQGAWAKVVVILLLTAGVDAHTRSIAGSVAHATSGLAGLFTSGAKQNIQLINTNGSWHINRTALNCNDSLN
   AY746460        IGGAHWGVMFGLAYFSMQGAWAKVVVILLLAAGVDAYTHTVGGAAASTANSIAGLLSRGPRQNLQLINSNGSWHINRTALNCHDSLQ
   HPCPOLP         IGGAHWGVMFGLAYFSMQGAWAKVVVILLLAAGVDAQTHTVGGSTAHNARTLTGMFSLGARQKIQLINTNGSWHINRTALNCNDSLH
   NC_009823       ISGAHWGVMFGLAYFSMQGAWAKVVVILLLAAGVDARTHTVGGSAAQTTGRLTSLFDMGPRQKIQLVNTNGSWHINRTALNCNDSLH

   HPCJ8G HC-J8    IFGGHWGVVFGLAYFSMQGAWAKVIAILLLVAGVDATTYSSGQEAGRTVAGFAGLFTTGAKQNLYLINTNGSWHINRTALNCNDSLQ
   AY232730        IFGGHWGVMFGLAYFSMQGAWAKVIVILLLVAGVDARHHTTGLQAGKTLARVTSLFSIGAKQNIQLINTNGSWHINRTALNCNDSLQ
2B AY232747        IFGGHWGVVFGLAYFSMQGAWAKVIAILLLVAGVDANTYSSGVTVGHTTSTFANIFSVGPSQKINLINTNGSWHINRTALNCNDSLQ
   AB030907        VFGGHWGVVFGLAYFSMQGAWAKVIAILLLVAGVDATTYSTGATVGRTVGSFAGLFKLGAQQNVQLINTNGSWHINRTALNCNDSLH
   DQ430817        VFGGHWGVVFGLAYFSMQGAWAKVIAILLLVAGVDAGTYSSGATIGQGTRGLV?LFSAGPSQKISLINTNGSWHINRT?LNCNDSLQ
                   440       450       460       470       480       490       500       510       520
Consensus          TGFIASLFYTXNFNSSGCPERLSACRGIEAFRIGWGTLQYEDNVTNPEDMRPYCWHYPPKXCGIVPARSVCGPVYCFTPSPVVVGTT
                                                                E2
   AB047639 (JFH1) TGFLAALFYTNRFNSSGCPGRLSACRNIEAFRIGWGTLQYEDNVTNPEDMRPYCWHYPPKPCGVVPARSVCGPVYCFTPSPVVVGTT
   AB047645        TGFIVSLFYARNFNSTGCPERLSACRGIEGFRIGWGTLQYEDNVTNPEDMRPYCWHYPPKQCGIVPAGSVCGPVYCFTPSPVVVGTT
   AF238482        TGFMAALFYTKNFNSSGCPERLS?CRNIEAFRIGWGTLQYEDDVTNPEDMRPYCWHYPPKQCGIFPAGSVCGPVYCFTPSPVVVGTT
2A AF169005        TGFIASLFYTYRFNSSGCPERLSACRGIQAFRIGWGTLRYEDNVTNPEDMRPYCWHYPPKQCGIVSARSVCGPVYCFTPSPVVVGTT
   AY746460        TGFITALFYARHFNSSGCPERLAACRNIEAFRVGWGALQYEDNVTNPEDMRPYCWHYPPKQCGIVPARSVCGPVYCFTPSPVVVGTT
   HPCPOLP         TGFLASLFYTHSFNSSGCPERMSACRSIEAFRVGWGALQYEDNVTNPEDMRPYCWHYPPRQCGVVSASSVCGPVYCFTPSPVVVGTT
   NC_009823       TGFIASLFYTHSFNSSGCPERMSACRSIEAFRVGWGALQYEDNVTNPEDMRPYCWHYPPRQCGVVSAKTVCGPVYCFTPSPVVVGTT

   HPCJ8G HC-J8    TGFLASLFYTHKFNSSGCPERLSSCRGLDDFRIGWGTLEYETNVTNDGDMRPYCWHYPPRPCGIVPARTVCGPVYCFTPSPVVVGTT
   AY232730        TGFIASLFYVNNINSSGCPERMSSCRELDDFRIGWGTLEYETNVTNDEDMRPYCWHYPPKPCGIVPARTVCGPVYCFTPSPIVVGTT
2B AY232747        TGFLASLFYVRNFNSSGCRERLSSCRRLDDFRIGWGTLEYETNVTNDEDMRPYCWHYPPKPCGIVSARTVCGPVYCFTPSPVVVGTT
   AB030907        TGFMAALFYANKFNSSGCPERLSSCRGLDDFRIGWGTLEYETNVTNVEDMRPYCWHYPPKPCGIVPAQSVCGPVYCFTPSPVVVGTT
   DQ430817        TGFIASLFYAKSFNSSGCPERLSSCRGLDDFRIGWGTLEYENNVTNDEDMRPYCWHYPPKPCGIVPARTVCGPVYCFTPSPVVVGTT
```

FIG. 2B

```
                      1       10        20        30        40        50        60        70        80
   Consensus          MSTLPKPQRKTKRNTIRRPQDVKFPGGGQIVGGVYVLPRRGPRLGVRATRKTSERSQPRGRRQPIPKARRSEGRSWAQPGYPWPLYGN
                      Core
3A AVI3a177           MSTLPKPQRKTKRNTIRRPQDVKFPGGGQIVGGVYVLPRRGPRLGVRATRKTSERSQPRERRQPIPKARRSDGRSWAQPGYPWPLYGN
   ADF97232(S52)      MSTLPKPQRKTKRNTIRRPQDVKFPGGGQIVGGVYVLPRRGPRLGVRATRKTSERSQPRGRRQPIPKARRSEGRSWAQPGYPWPLYGN
   YP_001469631       MSTLPKPQRKTKRNTIRRPQDVKFPGGGQIVGGVYVLPRRGPRLGVRATRKTSERSQPRGRRQPIPKARRSEGRSWAQPGYPWPLYGN
   CAA54244           MSTLPKPQRKTKRNTIRRPQDVKFPGGGQIVGGVYVLPRRGPRLGVRATRKTSERSQPRGRRQPIPKARRSEGRSWAQPGYPWPLYGN
   AAC03058           MSTLPKPQRKTKRNTIRRPQDVKFPGGGQIVGGVYVLPRRGPRLGVCATRKTSERSQPRRRRQPIPKARQSGGRSWAQPGYPWPLYGN
   AAY29642           MSTLPKPQRKTKRNTVCRPQDVKFPGGGQIVGGVYVLPRRGPRLGVRATRKTSERSQPRGRRQPIPKARRSEGRSWAQPGYPWPLYGN
   ABD85062           MSTLPKPQRKTKRNTIRRPQDVKFPGGGQIVGGVYVLPRRGPRLGVRATRKTSERSQPRGRRQPIPKARRSEGRSWAQPGYPWPLYGN
   ABD85063           MSTLPKPQRKTKRNTIRRPQDVKFPGGGQIVGGVYVLPRRGPRLGVRATRKTSERSQPRGRRQPIPKARRSEGRSWAQPGYPWPLYGN
   ABD97104           MSTLPKPQRKTKRNTIRRPQDVKFPGGGQIVGGVYVLPRRGPRLGVCATRKTSERSQPRGRRQPIPKARRSEGRSWAQPGYPWPLYGN
   BAA06044           MSTLPKPQRKTKRNTIRRPQDVKFPGGGVIYVGVYVLPRRGPRLGVRATRKTSERSQPRGRRKPIPKARRSEGRSWAQPGYPWPLYGN
3B BAA08372           MSTLPKPKRQTKRNTLRRPKNVKFPAGGQIVGEVYVLPRRGPQLGVREVRKTSERSQPRGRRQPTPKARPREGRSWAQPGYPWPLYGN
3K BAA09890           MSTLPKPQRITKRNINRRPQDVKFPGGGQIVGGVYVLPRRGPKLGVRAVRKTSERSQPRSRRQPIPRARRTEGRSWAQPGYPWPLYGN

                      90        100       110       120       130       140       150       160       170
   Consensus          EGCGWAGWLLSPRGSRPSWGPNDPRRRSRNLGKVIDTLTCGFADLMGYIPLVGAPVGGVARALAHGVRALEDGINFATGNLPGCSFSI
                      Core
3A AVI3a177           EGCGWAGWLLSPRGSRPSWGPNDPRRRSRNLGKVIDTLTCGFADLMGYIPIVGAPVGGVARALAHGVRALEDGINFATGNLPGCSFSI
   ADF97232(S52)      EGCGWAGWLLSPRGSRPSWGPNDPRRRSRNLGKVIDTLTCGFADLMGYIPLVGAPVGGVARALAHGVRALEDGINFATGNLPGCSFSI
   YP_001469631       EGCGWAGWLLSPRGSRPSWGPNDPRRRSRNLGKVIDTLTCGFADLMGYIPLVGAPVGGVARALAHGVRALEDGINFATGNLPGCSFSI
   CAA54244           EGCGWAGWLLSPRGSRPSWGQNDPRRRSRNLGKVIDTLTCGFADLMGYIPLVGAPVGGVARALAHGVRALEDGINFATGNLPGCSFSI
   AAC03058           EGCGWAGWLLSPRGSRPSWGPNDPRRRSRNLGKVIDTLTCGFADLMGYIPLVGAPVGGVARALAHGVRALEDGINFATGNLPGCSFSI
   AAY29642           EGCGWAGWLLSPRGSRPSWGPNDPRRRSRNLGKVIDTLTCGFADLMGYIPLVGAPVGGVARALAHGVRALEDGINFATGNLPGCSFSI
   ABD85062           EGCGWAGWLLSPRGSRPSWGPNDPRRRSRNLGKVIDTLTCGFADLMGYIPLVGAPVGGVARALAHGVRALEDGINFATGNLPGCSFSI
   ABD85063           EGCGWAGWLLSPRGSRPSWGPNDPRRRSRNLGKVIDTLTCGFADLMGYIPLVGAPVGGVARALAHGVRALEDGINFATGNLPGCSFSI
   ABD97104           EGCGWAGWLLSPRGSRPSWGPNDPRRRSRNLGKVIDTLTCGFADLMGYIPLVGAPVGGVARALAHGVRALEDGINFATGNLPGCSFSI
   BAA06044           EGCGWAGWLLSPRGSRPNWAPNDPRRRSRNLGKVIDTLTCGFADLMGYIPLVGAPLGGAARALAHGVRALEDGINFATGNLPGCSFSI
3B BAA08372           EGCGWAGWLLPPRGSRPSWGQNDPRRRSRNLGKVIDTLTCGFADLMGYIPLIGAPVGGVARALAHGVRALEDGVNYATGNLPGCSFSI
3K BAA09890           EGCGWAGWLLSPRGSRPSWGPNDPRRRSRNLGKVIDTLTCGFADLMGYIPLVGAPVGGVARALAHGVRALEDGINFATGNLPGCSFSI

                      180       190       200       210       220       230       240       250       260
   Consensus          FLLALFSCLIHPAASLEWRNTSGLYVLTNDCSNSSIVYEADDVILHTPGCVPCVQ-DGNTSTCWTPVTPTVAVRYVGATTASIRSHVD
                      Core            E1
3A AVI3a177           FLLALLSCLIHPAASLEWRNTSGLYILTNDCPNSSIVYEADDVILHTPGCIPCVQ-DGNTSTCWTSVSPTVAVRYVGATTASIRSHVD
   ADF97232(S52)      FLLALFSCLVHPAASLEWRNTSGLYVLTNDCSNSSIVYEADDVILHTPGCVPCVQ-DDNTSTCWTPVTPTVAVRYVGATTASIRSHVD
   YP_001469631       FLLALFSCLIHPAASLEWRNTSGLYVLTNDCSNSSIVYEADDVILHTPGCVPCVQ-DGNTSTCWTPVTPTVAVRYVGATTASIRSHVD
   CAA54244           FLLALFSCLIHPAASLEWRNTSGLYVLTNDCSNSSIVYEADDVILHTPGCVPCVQ-DGNTSTCWTPVTPTVAVRYVGATTASIRSHVD
   AAC03058           FLLALFSCLIHPAASLEWRNTSGLYVLTNDCSNSSIVYEADDVILHTPGCVPCVQ-NDNISTCWTPVTPTVAVRYVGATTASIRSHVD
   AAY29642           FLLALFSCLIHPAASLEWRNVSGLYILTNDCPNSSIVYEADDVILHTPGCIPCVQ-DGNTSTCWTALTPTVAVRYVGATTASIRSHVD
   ABD85062           FLLALFSCLIHPAASLQWRNTSGLYVLTNDCSNSSIVYEADDVILHTPGCVPCVQ-DGNTSTCWTPVTPTVAVRYVGATTASIRSHVD
   ABD85063           FLLALFSCLIHPAASLQWRNTSGLYVLTNDCSNSSIVYEADDVILHTPGCVPCVQ-DGNTSTCWTPVTPTVAVRYVGATTASIRSHVD
   ABD97104           FLLALFSCLVHPAASLEWRNTSGLYVLTNDCPNSSIVYEADDVILHTPGCIPCVQ-DGNKSTCWTSVTPTVAVKYVGATTASIRSHVD
   BAA06044           FLLALFSCLIHPAASLEWRNTSGLYVLTNDCSNSSIVYEADDVILHTPGCIPCVQ-DGNTSTCWTPVTPTVAVRYVGATTASIRSHVD
3B BAA08372           FLLALFSCLTCPASSLEYRNASGLYLLTNDCSNRSIVYEADDVILHLPGCVPCVETDNNNTSCWTPISPTVAVKHPGVTTASIRNHVN
3K BAA09890           FLLALLSCLLTPTAGLEYRNASGLYTVTNDCSNGSIVYEAGDVILHLPGCIPCVR-LNNASKCWTPVSPTVAVSRPGAATASLRTHVD
```

FIG. 3A

| Group | Sequence ID | Residues 270–350 |
|---|---|---|
| | Consensus | LLVGAATMCSALYVGDMCGAVFLVGQAFTFRPRRHQTVQTCNCSLYPGHLSGHRMAWDMMMNWSPAVGMVVAHVLRLPQTLFDIIAGA |
| | | E1 |
| 3A | AVI3a177 | LLVGAATLCSALYVGDMCGAVFLVGQAFTFRPRRHQTVQTCNCSLYPGHLTGHRMAWDMMMNWSPAVGMVVAHVLRMPQTVFDIIAGA |
| 3A | ADF97232(S52) | LLVGAATLCSALYVGDMCGAVFLVGQAFTFRPRRHQTVQTCNCSLYPGHVSGHRMAWDMMMNWSPAVGMVVAHILRLPQTLFDILAGA |
| 3A | YP_001469631 | LLVGAATMCSALYVGDMCGAVFLVGQAFTFRPRRHQTVQTCNCSLYPGHLSGHRMAWDMMMNWSPAVGMVVAHVLRLPQTLFDIMAGA |
| 3A | CAA54244 | LLVGAATMCSALYVGDMCGAVFLVGQAFTFRPRRHQTVQTCNCSLYPGHLSGHRMAWDMMMNWSPAVGMVVSHVLRLPQTLFDIIAGA |
| 3A | AAC03058 | LLVGAATMCSALYVGDMCGAVFLVGQAFTFRPRRHQTVQTCNCSLYPGHLSGHRMAWDMMMNWFPALGMAVAHVLRVPQTLFDIIAGA |
| 3A | AAY29642 | LLVGAATMCSALYVGDMCGAVFLVGQAFTFRPRRHQTVQTCNCSLYPGHLTGHRMAWDMMMNWSPAVGMVVAHVLRLPQTLFDIIAGA |
| 3A | ABD85062 | LLVGAATMCSALYVGDMCGAVFLVGQAFTFRPRRHQTVQTCNCSLYPGHLSGHRMAWDMMMNWSPAAGMVVAHILRLPQTLFDIIAGA |
| 3A | ABD85063 | LLVGAATMCSALYVGDMCGAVFLVGQAFTFRPRRHQTVQTCNCSLYPGHLSGHRMAWDMMMNWSPAAGMVVAHILRLPQTLFDIIAGA |
| 3A | ABD97104 | LLVGAATMCSALYVGDMCGAVFLVGQAFTFRPRRHQTVQTCNCSLYPGHLSGHRMAWDMMMNWSPAVGMVVAHVLRLPQTLFDIIAGA |
| 3A | BAA06044 | LLVGAGTMCSALYVGDMCGPVFLVGQAFTFRPRRHRTVQTCNCSLYPGHLSGQRMAWDMMMNWSPAVGMVVAHILRLPQTLFDVVAGA |
| 3B | BAA08372 | MLVAPPTLCSALYVEDAFGAVSLVGQAFTFRPRQHKTVQTCNCSIYPGHVSGHRMAWDMMMNWSPAIGLVISHLMRLPQTFFDLVVGA |
| 3K | BAA09890 | MMVGAATLCSALYVGDLCGALFLVGQGFSWRHRQHWTVQDCNCSIYPGHLTGHRMAWDMMMNWSPAMTLIVSQVLRLPQTMFDLVIGA |

| Group | Sequence ID | Residues 360–440 |
|---|---|---|
| | Consensus | HWGILAGLAYYSMQGNWAKVAIIMVMFSGVDATTYTTGGSAARGARGLTSLFSVGAKQKLQLVNTNGSWHINSTALNCNXSINTGFIA |
| | | E1 / E2 |
| 3A | AVI3a177 | HWGILAGLAYYSMQGNWAKVAIIMVMFSGVDAETHTTGGTAARNAFTLTGLFTQGARQKLELINTNGSWHINRTALNCNESLNTGFIA |
| 3A | ADF97232(S52) | HWGILAGLAYYSMQGNWAKVAIVMIMFSGVDAETYVTGGSVAHSARGLTSLFSMGAKQKLQLVNTNGSWHINSTALNCNESINTGFIA |
| 3A | YP_001469631 | HWGILAGLAYYSMQGNWAKVAIIMVMFSGVDAHTYTTGGTASRHTQAFAGLFDIGPQQKLQLVNTNGSWHINSTALNCNESINTGFIA |
| 3A | CAA54244 | HWGILAGLAYYSMQGNWAKVAVIMVMFSGVDAETYITGGSAAHGVSTLTSLFSSGPQQKLQLVKTNGSWHINSTALNCNESINTGFIA |
| 3A | AAC03058 | HWGILAGLAYYSMQGNWAKVAIIMVMFSGVDAVTYTTGGSAAHATRGLTSLFSVGAQQKLQLVNTNGSWHINSTALNCNESINTGFIA |
| 3A | AAY29642 | HWGILAGLAYYSMQGNWAKVIIIMVMFSGVDATTHVTGGTAGLTAFRLTGLFTVGPQQKLQLVNTNGSWHINRTALNCNDSLNTGFIA |
| 3A | ABD85062 | HWGILAGLAYYSMQGNWAKVAIIMVMFSGVDATTYTSGGSVAQQARGLADLFSVGAKQNLQLVNTNGSWHINSTALNCDDSINTGFIA |
| 3A | ABD85063 | HWGILAGLAYYSMQGNWAKVAIIMVMFSGVDATTYTSGGSVAQQARGLADLFSVGAKQNLQLVNTNGSWHINSTALNCDDSINTGFIA |
| 3A | ABD97104 | HWGILAGLAYYSMQGNWAKVAIIMVMFSGVDATTYTTGGNAARGASGIVSLFTPGAKQNLQLVNTNGSWHINRTALNCNDSINTGFIA |
| 3A | BAA06044 | HWGIIAGLAYYSMQGNWAKVAIIMVMFSGVDASTHVTAGQAARNAYGITSLFSVGAKQNLQLINTNGSWHINRTALNCNESINTGFIA |
| 3B | BAA08372 | HWGVMAGLAYFSMQGNWAKVVIVLIMFSGVDATTHTTGGSAAQATAGFTSFFTRGPSQNLQLVNSNGSWHINSTALNCNDSLNTGFIA |
| 3K | BAA09890 | HWGVMAGVAYYSMQGNWAKVFLVLCLFSGVDASTTITGGVAASGAFTITSLFSTGAKQPLHLVNTNGSWHINRTALNCNDSLNTGFIA |

| Group | Sequence ID | Residues 450–520 |
|---|---|---|
| | Consensus | GLFYYHKFNSTGCPQRLSSCKPITFFXQGWGPLTDANITGPSDDKPYCWHYAPRPCDVVPASSVCGPVYCFTPSPVVVGTTDAKGVPT |
| | | E2 |
| 3A | AVI3a177 | GLFYLHKFNSTGCPERLSSCKPITFFRQGWGSLTDANITGPSDDKPYCWHYAPRPCEVVPALNVCGPVYCFTPSPVVVGTTDRQGVPT |
| 3A | ADF97232(S52) | GLFYYHKFNSTGCPQRLSSCKPIISFRQGWGPLTDANITGPSDDRPYCWHYAPRPCSVVPASSVCGPVYCFTPSPVVVGTTDIKGKPT |
| 3A | YP_001469631 | GLFYYHKFNSTGCPQRLSSCKPITFFRQGWGPLTDANITGPSDDRPYCWHYAPRPCDIVPASSVCGPVYCFTPSPVVVGTTDARGVPT |
| 3A | CAA54244 | GLFYYHKFNSTGCPQRLSSCKPITFFRQGWGSLTDANVTGASADKPYCWHYAPRPCDVVPALNVCGPVYCFTPSPVVVGTTDRKGVPT |
| 3A | AAC03058 | GLFYYHRFNSTGCPQRLSSCKPITFFKQGWGPLTDANISGPSDDKPYCWHYAPRPCKVVPASGVCGPVYCFTPSPVVVGTTDAKGVPT |
| 3A | AAY29642 | GLFRFHKFNSTGCPEMLSSCKPITSFKQGWGPLTDANITIPSDDRPYCWHYPPRSCEVVPALSVCGPVYCFTPSPVVVGTTDAKGVPT |
| 3A | ABD85062 | GLFYYHKFNSTGCPQRLSDCKPITFFKQGWGPLTDANITGPSDDKPYCWHYAPRRCGVVPASSVCGPVYCFTPSPVVVGTTDAKGVPT |
| 3A | ABD85063 | GLFYYHKFNSTGCPQRLSDCKPITFFKQGWGPLTDANITGPSDDKPYCWHYAPRRCGVVPASSVCGPVYCFTPSPVVVGTTDAKGVPT |
| 3A | ABD97104 | GLIYYHKFNSTGCPQRLSSCKPITFFRQGWGSLTDANITGPSDDKPYCWHYPPRPCDTIRASSVCGPVYCFTPSPVVVGTTDAKGAPT |
| 3A | BAA06044 | GLFYYHKFNSTGCPQRLSSCKPITFFKQGWGPLTDANITGPSDDKPYCWHYAPRPCGIVPALNVCGPVYCFTPSPVVVGTTDAKGAPT |
| 3B | BAA08372 | GLFYYHKFNSSGCPERMSSCKPITYFNQGWGPLTDANINGPSEDRPYCWHYPPRPCNITKPLNVCGPVYCFTPSPVVVGTTDIKGLPT |
| 3K | BAA09890 | GLLYYHKFNSSGCVERMSACSPLDRFAQGWGPLGPANISGPSSEKPYCWHYAPRPCDTVPAQSVCGPVYCFTPSPVVVGATDKRGAPT |

FIG. 3B

FIG. 5A
GenBank 3S7G_A
*Homo sapiens* IgG1 Fc
227 aa

```
  1 dkthtcppcp apellggpsv flfppkpkdt lmisrtpevt cvvvdvshed pevkfnwyvd
 61 gvevhnaktk preeqynsty rvvsvltvlh qdwlngkeyk ckvsnkalpa piektiskak
121 gqprepqvyt lppsrdeltk nqvsltclvk gfypsdiave wesngqpenn ykttppvlds
181 dgsfflyskl tvdksrwqqg nvfscsvmhe alhnhytqks lslspgk
```

GenBank AAN76044
*Homo sapiens* IgG2 Fc (amino acids 99-325)
227 aa

```
  1 stkgpsvfpl apcsrstses taalgclvkd yfpepvtvsw nsgaltsgvh tfpavlqssg
 61 lyslssvvtv pssnfgtqty tcnvdhkpsn tkvdktverk ccvecppcpa ppvagpsvfl
121 fppkpkdtlm isrtpevtcv vvdvshedpe vqfnwyvdgv evhnaktkpr eeqfnstfrv
181 vsvltvvhqd wlngkeykck vsnkglpapi ektisktkgq prepqvytlp psreemtknq
241 vsltclvkgf ypsdiavewe sngqpennyk ttppmldsdg sfflyskltv dksrwqqgnv
301 fscsvmheal hnhytqksls lspgk
```

GenBank AAW65947
*Homo sapiens* IgG3 Fc (amino acids 19-246)
238 aa

```
  1 hkpsntkvdk rvelktplgd tthtcppcpa pellggpsvf lfppkpkdtl misrtpevtc
 61 vvvdvshedp evkfnwyvdg vevhnaktkp reeqynstyr vvsvltvlhq dwlngkeykc
121 kvsnkalpap iektiskakg qprepqvytl ppsrdeltkn qvsltclvkg fypsdiavew
181 esngqpenny kttppvldsd gsfflysklt vdksrwqqgn vfscsvmhea lhnhytqksl
241 slspgk
```

FIG. 5B

GenBank AAA52770
*Homo sapiens* IgD Fc (amino acids 162-383)
222 aa

```
  1 ptkapdvfpi isgcrhpkdn spvvlaclit gyhptsvtvt wymgtqsqpq rtfpeiqrrd
 61 syymtssqls tplqqwrqge ykcvvqhtas kskkeifrwp espkaqassv ptaqpqaegs
121 lakattapat trntgrggee kkkekekeeq eeretktpec pshtqplgvy lltpavqdlw
181 lrdkatftcf vvgsdlkdah ltwevagkvp tggveeglle rhsngsqsqh srltlprslw
241 nagtsvtctl nhpslppqrl malrepaaqa pvklslnlla ssdppeaasw llcevsgfsp
301 pnillmwled qrevntsgfa parpppqprs ttfwawsvlr vpappspqpa tytcvvshed
361 srtllnasrs levsyvtdhg pmk
```

GenBank 0308221A
*Homo sapiens* IgM Fc
276 aa

```
  1 vtstltikzs dwlgesmftc rvdhrgltfq qnassmcvpd qdtairvfai ppsfasiflt
 61 kstkltclvt dlttybsvti swtreengav kthtnisesh pnatfsavge asicedbdws
121 gerftctvth tdlpsplkqt isrpkgvalh rpbvyllppa rzzlnlresa titclvtgfs
181 padvfvewmq rgeplspqky vtsapmpepq apgryfahsi ltvseeewnt ggtytcvvah
241 ealpnrvter tvdkstgkpt lynvslvmsd tagtcy
```

FIG. 5C

GenBank P01876
*Homo sapiens* IgA Fc (amino acids 120-353)
234 aa

```
  1 asptspkvfp lslcstqpdg nvviaclvqg ffpqeplsvt wsesgqgvta rnfppsqdas
 61 gdlyttssql tlpatqclag ksvtchvkhy tnpsqdvtvp cpvpstpptp spstpptpsp
121 scchprlslh rpaledlllg seanltctlt glrdasgvtf twtpssgksa vqgpperdlc
181 gcysvssvlp gcaepwnhgk tftctaaype sktpltatls ksgntfrpev hllpppseel
241 alnelvtltc largfspkdv lvrwlqgsqe lprekyltwa srqepsqgtt tfavtsilrv
301 aaedwkkgdt fscmvgheal plaftqktid rlagkpthvn vsvvmaevdg tcy
```

GenBank 1F6A_B
*Homo sapiens* IgE Fc (amino acids 6-222)
212 aa

```
  1 adpcdsnprg vsaylsrpsp fdlfirkspt itclvvdlap skgtvnltws rasgkpvnhs
 61 trkeekqrng tltvtstlpv gtrdwieget yqcrvthphl pralmrsttk tsgpraapev
121 yafatpewpg srdkrtlacl iqnfmpedis vqwlhnevql pdarhsttqp rktkgsgffv
181 fsrlevtrae weqkdeficr avheaaspsq tvqravsvnp gk
```

GenBank P01861
*Homo sapiens* IgG4 Fc (amino acids 100-327)
228 aa

```
  1 astkgpsvfp lapcsrstse staalgclvk dyfpepvtvs wnsgaltsgv htfpavlqss
 61 glyslssvvt vpssslgtkt ytcnvdhkps ntkvdkrves kygppcpscp apeflggpsv
121 flfppkpkdt lmisrtpevt cvvvdvsqed pevqfnwyvd gvevhnaktk preeqfnsty
181 rvvsvltvlh qdwlngkeyk ckvsnkglps siektiskak gqprepqvyt lppsqeemtk
241 nqvsltclvk gfypsdiave wesngqpenn ykttppvlds dgsfflysrl tvdksrwqeg
301 nvfscsvmhe alhnhytqks lslslgk
```

FIG. 6

Table 1. Conserved Regions based on the conserved CD4 epitopes

| No. | Residues* | Length | Sequence | Genotype Conservancy | # of included Epitopes |
|---|---|---|---|---|---|
| **CD4-R1** | 1251-1265 | 15 | VLVLNPSVAATLGFG | HCV1a, 1b, 2a, 2b, 3, 4, 5, 6, 7 | 2 |
| **CD4-R2** | 1295-1309 | 15 | TYGKFLADGGCSGGA | HCV1a, 1b, 3, 4, 5, 6, 7 | 2 |
| **CD4-R3** | 1387-1401 | 15 | GGRHLIFCHSKKKCD | HCV1a, 1b, 2a, 2b, 3, 4, 5, 6, 7 | 4 |
| **CD4-R4** | 1415-1425 | 11 | VAYYRGLDVSV | HCV1a, 1b, 2b, 3, 4, 7 | 4 |
| **CD4-R5** | 1436-1453 | 18 | ATDALMTGFTGDFDSVID | HCV1a, 1b, 3, 4, 7 | 2 |
| **CD4-R6** | 1563-1577 | 15 | TGLTHIDAHFLSQTK | HCV1a, 1b, 2a, 2b, 3, 7 | 1 |
| **CD4-R7** | 1773-1785 | 13 | QYLAGLSTLPGNP | HCV1a, 1b, 2a, 2b, 3, 4, 5, 6, 7 | 4 |
| **CD4-R8** | 1881-1888 | 8 | NLLPAILS | HCV1a, 1b, 2b, 3, 4, 7 | 1 |
| **CD4-R9** | 1904-1930 | 27 | RHVGPGEGAVQWMNRLIAFASRGNHVS | HCV1a, 1b, 3, 4 | 3 |
| **CD4-R10** | 2201-2215 | 15 | SSASQLSAPSLKATC | HCV1a, 1b, 2b, 3, 4, 5, 6 | 1 |
| **CD4-R11** | 2788-2792 | 5 | SNVSV | HCV1a, 1b, 2a, 2b, 3, 4, 5, 6, 7 | 1 |

* Numbers are based on HCV1a genotype sequence. R = region

FIG. 7

Table 2. Number of located HCV CD8 T cell epitopes and anchor positions for common each HLA-I Alleles in USA

| MHC-I Allele | Total Epitopes (#) | Located Epitopes (#) | Allele-specific Anchor Positions | | | |
|---|---|---|---|---|---|---|
| | | | 2 | | 9 | Others |
| **A*02:01** | 48 | 29 | **M#**, **L**, Q, V, I | | **V**, **L**, **I**, A, M | F (1, 3, 7) |
| **A*24:02** | 33 | 20 | **Y**, **W**, F | | **F**, **I**, **W**, L, M | F, W (7) |
| **A*03:01** | 10 | 6 | **M**,**L**, **I**, **V**, **T**, S, Q, A | | **K**, Y, R | F & Y (3), K & R (1) |
| **A*01:01** | 4 | 3 | **T**, **S**, A, V, M, I, L | | **Y**, F | **D** (3) |
| **B*35:01** | 1 | 1 | **P**, G, A | | **Y**, **M**, **F**, H | M (1), A (8), W (1), F (1), Y (1), P (8) |
| | | | 5 | | 9 | Others |
| **B*08:01** | 2 | 1 | **R**, **K**, **H**, F | | **L**, **M**, **I**, **F**, **V**, A, W | K (3), R (3), L (2), F (6), M (1, 2, 3), P (2), S (8) |
| | | | 1 | 2 | 9 | Others |
| **B*40:02** | 2 | 2 | **Y**, **K**, **R**, **A**, **H**, **W**, **G**, **F**, Q, L, S, C, I, T, M, V | **E**, D | **I**, **L**, **A**, **V**, **F**, **M**, **T**, W, S, C | F (3), P (8), A (8) |
| **C*03:03** | 2 | 2 | NA## | | NA | NA |
| **A*33:03** | 1 | 0 | - | | - | - |
| **A*02:06** | 1 | 0 | - | | - | - |
| **A*26:01** | 1 | 0 | - | | - | - |
| **A*31:01** | 1 | 0 | - | | - | - |
| **Total** | 106 | 64 | | | | |

Bold Anchor positions describe the optimal amino acid for that location. ## Not Available

FIG. 8

Table 3. Conserved Regions based on the conserved CD8 Epitopes

| No. | Residues* | Length | Sequence | Conserved HCV1a, 1b, & 3 | Conserved 9** Genotypes | # of epitopes |
|---|---|---|---|---|---|---|
| CD8-R1 | 1292-1300 | 9 | TYSTYGKFL | Yes | Yes | 2 |
| CD8-R2 | 1391-1399 | 9 | LIFCHSKKK | Yes | Yes | 2 |
| CD8-R3 | 1436-1451 | 16 | ATDALMTGFTGDFDSV | Yes | No | 2 |
| CD8-R4 | 1666-1675 | 10 | VLAALAAYCL | Yes | No | 1 |
| CD8-R5 | 1851-1859 | 9 | ILAGYGAGV | Yes | No | 1 |
| CD8-R6 | 1373-1380 | 8 | IPFYGKAI | Yes | No | 1 |
| CD8-R7 | 1596-1604 | 9 | RAQAPPPSW | Yes | No | 1 |
| CD8-R8 | 1910-1945 | 36 | EGAVQWMNRLIAFASRGN HVSPTHYVPESDAAARVT | Yes | No | 3 |
| CD8-R9 | 2290-2298 | 9 | RPDYNPPLL | Yes | No | 1 |
| CD8-R10 | 2557-2565 | 9 | TIMAKNEVF | Yes | Yes | 1 |

* Numbers are based on HCV1a genotype sequence.

** Nine genotypes include HCV1a, 1b, 2a, 2b, 3, 4, 5, 6, and 7

FIG. 9A. CD4 and CD8 epitopes for Core, P7, and NS2 regions

| Name | Type of epitope | Start* | End* |
|---|---|---|---|
| **Core-1** | CD4 | 1 | 20 |
| **Core-2** | CD4 | 11 | 30 |
| **Core-3** | CD4 | 21 | 40 |
| **Core-4** | CD4 | 39 | 63 |
| **Core-5** | CD4 | 47 | 70 |
| **Core-6** | CD4 | 61 | 80 |
| **Core-7** | CD4 | 71 | 90 |
| **Core-8** | CD4 | 81 | 100 |
| **Core-9** | CD4 | 91 | 110 |
| **Core-10** | CD4 | 101 | 115 |
| **Core-11** | CD4 | 111 | 130 |
| **Core-12** | CD4 | 125 | 139 |
| **Core-13** | CD4 | 131 | 150 |
| **Core-14** | CD4 | 151 | 170 |
| **Core-15** | CD4 | 161 | 180 |
| **Core-16** | CD8 | 35 | 44 |
| **Core-17** | CD8 | 43 | 51 |
| **Core-18** | CD8 | 51 | 59 |
| **Core-19** | CD8 | 129 | 137 |
| **Core-20** | CD8 | 131 | 140 |
| **Core-21** | CD8 | 150 | 158 |
| **Core-22** | CD8 | 154 | 162 |
| **Core-23** | CD8 | 168 | 176 |
| **Core-24** | CD8 | 177 | 187 |
| **Core-25** | CD8 | 178 | 187 |
| **P7-1** | CD8 | 803 | 811 |
| **NS2-1** | CD4 | 955 | 974 |
| **NS2-2** | CD4 | 975 | 994 |
| **NS2-3** | CD4 | 985 | 1,004 |
| **NS2-4** | CD4 | 1,015 | 1,034 |
| **NS2-5** | CD4 | 1,035 | 1,054 |
| **NS2-6** | CD8 | 924 | 933 |
| **NS2-7** | CD8 | 961 | 970 |
| **NS2-8** | CD8 | 989 | 997 |

* Start and End numbers are based on sequence designated "Consensus" in Fig. 12A-12L.

FIG. 9B. CD4 and CD8 epitopes that are conserved among genotypes 1a, 1b, 2a, 2b, and 3

| Name | Type of epitope | Start* | End* |
|---|---|---|---|
| **NS3-1** | CD4 | 1,265 | 1,279 |
| **NS3-2** | CD4 | 1,309 | 1,323 |
| **NS3-3** | CD4 | 1,401 | 1,415 |
| **NS3-4** | CD4 | 1,402 | 1,412 |
| **NS3-5** | CD4 | 1,429 | 1,439 |
| **NS3-6** | CD4 | 1,450 | 1,464 |
| **NS3-7** | CD4 | 1,453 | 1,467 |
| **NS3-8** | CD4 | 1,577 | 1,591 |
| **NS3-9** | CD8 | 1,306 | 1,314 |
| **NS3-10** | CD8 | 1,387 | 1,394 |
| **NS3-11** | CD8 | 1,405 | 1,413 |
| **NS3-12** | CD8 | 1,450 | 1,458 |
| **NS3-13** | CD8 | 1,457 | 1,465 |
| **NS3-14** | CD8 | 1,610 | 1,618 |
| **NS4a-1** | CD8 | 1,683 | 1,692 |
| **NS4b-1** | CD4 | 1,790 | 1,801 |
| **NS4b-2** | CD4 | 1,792 | 1,802 |
| **NS4b-3** | CD4 | 1,898 | 1,905 |
| **NS4b-4** | CD4 | 1,921 | 1,935 |
| **NS4b-5** | CD4 | 1,922 | 1,941 |
| **NS4b-6** | CD4 | 1,928 | 1,947 |
| **NS4b-7** | CD8 | 1,868 | 1,876 |
| **NS4b-8** | CD8 | 1,927 | 1,942 |
| **NS4b-9** | CD8 | 1,932 | 1,940 |
| **NS4b-10** | CD8 | 1,948 | 1,962 |
| **NS5a-1** | CD4 | 2,218 | 2,232 |
| **NS5a-2** | CD8 | 2,309 | 2,317 |
| **NS5b-1** | CD4 | 2,847 | 2,851 |
| **NS5b-2** | CD8 | 2,602 | 2,610 |

* Start and End numbers are based on sequence designated "Consensus" in Fig. 12A-12L.

FIG. 10A

| Name | Sequence* | Start** | End** | Contained Epitopes |
|---|---|---|---|---|
| **TP29** | AIPLEVIKGGRHLIFCHSKKKCDELAAKL | 1,393 | 1,421 | NS3-3, NS3-4, NS3-11 |
| **TP50** | LGALTGTYVYNHLTPLRDWAHNGLRDLAVAVEPVVFSQMETKLITWGADT | 955 | 1,004 | NS2-1, NS2-2, NS2-3, NS2-7, NS2-8 |
| **TP52** | AIPLEVIKGGRHLIFCHSKKKCDELAAKLVALGINAVAYYRGLDVSVIPTSG | 1,393 | 1,444 | NS3-3, NS3-4, NS3-5, NS3-11 |
| **TP70** | KGGRHLIFCHSKKKCDELAAKLVALGINAVAYYRGLDVSVIPTSGDVVVVATDALMTGFTGDFDSVIDCN | 1,400 | 1,469 | NS3-3, NS3-4, NS3-5, NS3-6, NS3-7, NS3-11, NS3-12, NS3-13 |
| **TP100** | VALSTTGEIPFYGKAIPLEVIKGGRHLIFCHSKKKCDELAAKLVALGINAVAYYRGLDVSVIPTSGDVVVVATDALMTGFTGDFDSVIDCNTCVTQTVDF | 1,379 | 1,478 | NS3-3, NS3-4, NS3-5, NS3-6, NS3-7, NS3-10, NS3-11, NS3-12, NS3-13 |
| **TP171** | MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPG | 1 | 171 | Core-1, Core-2, Core-3, Core-4, Core-5, Core-6, Core-7, Core-8, Core-9, Core-10, Core-11, Core-12, Core-13, Core-14, Core-16, Core-17, Core-18, Core-19, Core-20, Core-21, Core-22 |
| **TP228** | LHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGFTGDFDSVIDCN | 1,242 | 1,469 | NS3-1, NS3-2, NS3-3, NS3-4, NS3-5, NS3-6, NS3-7, NS3-9, NS3-10, NS3-11, NS3-12, NS3-13 |
| **TP553** | QASLLKVPYFVRVQGLLRICALARKMAGGHYVQMAIIKLGALTGTYVYNALTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDSRGSLLSPRPISYLKGSAGGPLLCPAGHAVGIFRAAVCTRGVAKAVDFIPVENLETTMRSPVFTDNSSPPAVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGK | 917 | 1,469 | NS2-1, NS2-2, NS2-3, NS2-4, NS2-5, NS2-6, NS2-7, NS2-8, NS3-1, NS3-2, NS3-3, NS3-4, NS3-5, NS3-6, NS3-7, NS3-9, NS3-10, NS3-11, NS3-12, NS3-13 |

FIG. 10B

| | | | | |
|---|---|---|---|---|
| | AIPLEVIKGGRHLIFCHSKKKCDELAAKLV ALGINAVAYYRGLDVSVIPTSGDVVVVAT DALMTGFTGDFDSVIDCN | | | |
| **TP778** | LHAPTGSGKSTKVPAAYAAQGYKVLVLNP SVAATLGFGAYMSKAHGIDPNIRTGVRTIT TGSPITYSTYGKFLADGGCSGGAYDIIICDE CHSTDATSILGIGTVLDQAETAGARLVVLA TATPPGSVTVPHPNIEEVALSTTGEIPFYGK AIPLEVIKGGRHLIFCHSKKKCDELAAKLV ALGINAVAYYRGLDVSVIPTSGDVVVVAT DALMTGFTGDFDSVIDCNTCVTQTVDFSL DPTFTIETTTLPQDAVSRTQRRGRTGRGKP GIYRFVAPGERPSGMFDSSVLCECYDAGCA WYELTPAETTVRLRAYMNTPGLPVCQDHL EFWEGVFTGLTHIDAHFLSQTKQSGENLPY LVAYQATVCARAQAPPPSWDQMWKCLIR LKPTLHGPTPLLYRLGAVQNEVTLTHPITK YIMTCMSADLEVVTSTWVLVGGVLAALA AYCLSTGCVVIVGRIVLSGKPAIIPDREVLY REFDEMEECSQHLPYIEQGMMLAEQFKQK ALGLLQTASRQAEVIAPAVQTNWQKLEAF WAKHMWNFISGIQYLAGLSTLPGNPAIASL MAFTAAVTSPLTTSQTLLFNILGGWVAAQ LAAPGAATAFVGAGLAGAAIGSVGLGKVL VDILAGYGAGVAGALVAFKIMSGEVPSTE DLVNLLPAILSPGALVVGVVCAAILRRHVG PGEGAVQWMNRLIAFASRGNHVSPTHYVP ESDAAARVTAILSSLTVTQLLRRLHQWISS ECTTPCSGSWLRDIWDWICEVLSDFKTWL KAKLMPQLPG | 1,242 | 2,022 | NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10 |

FIG. 10C

| | | | | |
|---|---|---|---|---|
| **TP1985** | APITAYAQQTRGLLGCIITSLTGRDKNQVE<br>GEVQIVSTAAQTFLATCINGVCWTVYHGA<br>GTRTIASPKGPVIQMYTNVDQDLVGWPAP<br>QGARSLTPCTCGSSDLYLVTRHADVIPVRR<br>RGDSRGSLLSPRPISYLKGSAGGPLLCPAG<br>HAVGIFRAAVCTRGVAKAVDFIPVENLETT<br>MRSPVFTDNSSPPAVPQSFQVAHLHAPTGS<br>GKSTKVPAAYAAQGYKVLVLNPSVAATL<br>GFGAYMSKAHGIDPNIRTGVRTITTGSPITY<br>STYGKFLADGGCSGGAYDIIICDECHSTDA<br>TSILGIGTVLDQAETAGARLVVLATATPPG<br>SVTVPHPNIEEVALSTTGEIPFYGKAIPLEVI<br>KGGRHLIFCHSKKKCDELAAKLVALGINA<br>VAYYRGLDVSVIPTSGDVVVVATDALMTG<br>FTGDFDSVIDCNTCVTQTVDFSLDPTFTIET<br>TTLPQDAVSRTQRRGRTGRGKPGIYRFVAP<br>GERPSGMFDSSVLCECYDAGCAWYELTPA<br>ETTVRLRAYMNTPGLPVCQDHLEFWEGVF<br>TGLTHIDAHFLSQTKQSGENLPYLVAYQAT<br>VCARAQAPPPSWDQMWKCLIRLKPTLHGP<br>TPLLYRLGAVQNEVTLTHPITKYIMTCMSA<br>DLEVVTSTWVLVGGVLAALAAYCLSTGC<br>VVIVGRIVLSGKPAIIPDREVLYREFDEMEE<br>CSQHLPYIEQGMMLAEQFKQKALGLLQTA<br>SRQAEVIAPAVQTNWQKLEAFWAKHMWN<br>FISGIQYLAGLSTLPGNPAIASLMAFTAAVT<br>SPLTTSQTLLFNILGGWVAAQLAAPGAATA<br>FVGAGLAGAAIGSVGLGKVLVDILAGYGA<br>GVAGALVAFKIMSGEVPSTEDLVNLLPAIL<br>SPGALVVGVVCAAILRRHVGPGEGAVQW<br>MNRLIAFASRGNHVSPTHYVPESDAAARV<br>TAILSSLTVTQLLRRLHQWISSECTTPCSGS<br>WLRDIWDWICEVLSDFKTWLKAKLMPQLP<br>GIPFVSCQRGYRGVWRGDGIMHTRCHCGA<br>EITGHVKNGTMRIVGPRTCRNMWSGTFPIN<br>AYTTGPCTPLPAPNYTFALWRVSAEEYVEI<br>RQVGDFHYVTGMTTDNLKCPCQVPSPEFF<br>TELDGVRLHRFAPPCKPLLREEVSFRVGLH<br>EYPVGSQLPCEPEPDVAVLTSMLTDPSHIT<br>AEAAGRRLARGSPPSVASSSASQLSAPSLK<br>ATCTANHDSPDAELIEANLLWRQEMGGNI<br>TRVESENKVVILDSFDPLVAEEDEREISVPA<br>EILRKSRRFAPALPIWARPDYNPPLLETWK<br>KPDYEPPVVHGCPLPPPQSPPVPPPRKKRT<br>VVLTESTVSTALAELATKSFGSSSTSGITGD<br>NTTTSSEPAPSGCPPDSDAESYSSMPPLEGE | 1041 | 3073 | NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10, NS5a-1, NS5a-2, NS5b-1, NS5b-2 |

FIG. 10D

| | | | | |
|---|---|---|---|---|
| | PGDPDLSDGSWSTVSSEADTEDVVCCSMS<br>YSWTGALVTPCAAEEQKLPINALSNSLLRH<br>HNLVYSTTSRSACQRQKKVTFDRLQVLDS<br>HYQDVLKEVKAAASKVKANLLSVEEACSL<br>TPPHSAKSKFGYGAKDVRCHARKAVNHIN<br>SVWKDLLEDSVTPIDTTIMAKNEVFCVQPE<br>KGGRKPARLIVFPDLGVRVCEKMALYDVV<br>SKLPLAVMGSSYGFQYSPGQRVEFLVQAW<br>KSKKTPMGFSYDTRCFDSTVTESDIRTEEAI<br>YQCCDLDPQARVAIKSLTERLYVGGPLTNS<br>RGENCGYRRCRASGVLTTSCGNTLTCYIK<br>ARAACRAAGLQDCTMLVCG**NN**LVVICESA<br>GVQEDAASLRAFTEAMTRYSAPPGDPPQP<br>EYDLELITSCSSNVSVAHDGAGKRVYYLTR<br>DPTTPLARAAWETARHTPVNSWLGNIIMF<br>APTLWARMILMTHFFSVLIARDQLEQALD<br>CEIYGACYSIEPLDLPPIIQRLHGLSAFSLHS<br>YSPGEINRVAACLRKLGVPPLRAWRHRAR<br>SVRARLLSRGGRAAICGKYLFNWAVRTKL<br>KLTPIAAAGQLDLSGWFTAGYSGGDIYHS<br>VSHARPRWFWFCLLLLAAGVGIYLLPNR | | | |

* TP sequences are based on HCV1a consensus sequence and gaps were removed

** Start and End numbers are based on sequence designated “Consensus” in Fig. 16A-16L.

230 240 250 260 270 280 290

E1

HCV1a consensus TPGCVPCVR-EGNASRCWVAVTPTVATRDGKLPTTQLRRHIDLLVGSATLCSALYVGDLCGSVFLVGQLFTFSP 300 310 320 330 340 350 360 370

E1

HCV1a consensus RRHWTTQDCNCSIYPGHITGHRMAWDMMMNWSPTTALVVAQLLRIPQAILDMIAGAHWGVLAGIAYFSMVGNWA 380 390 400 410 420 430 440

E1 E2

HCV1a consensus KVLVVLLLFAGVDAETHVTGGSAARTTSGLASLFTPGAKQNIQLINTNGSWHINRTALNCNDSLNTGWLAGLFY

HCV1a consensus YHKFNSSGCPERLASCRPLTDFDQGWGPISYANG-SGP-DQRPYCWHYPPKPCGIVPAKSVCGPVYCFTP--SP 520 530 540 550 560 570 580 590

E2

HCV1a consensus VVVGTTDRSGAPTYNWGENDTDVFVLNNTRPPLGNWFGCTWMNST-GFTKVCGAPPCVI-GGVGN-----NTLH 600 610 620 630 640 650 660

E2

HCV1a consensus CPTDCFRKHPEATYSRCGSGPWITPRCLVDYPYRLWHYPCTINYTIFKVRMYVGGVEHRLEAACNWTRGERCDL

FIG. 11C

```
                    1         10            20            30            40            50            60            70            80
Consensus           MSTNPKPQRKTKRNTNRRPQDVKFPGGGQIVGGVYLLPRRGPRLGVRATRKTSERSQPRGRRQPIPKARRSEGRSWAQPGYPWPLY
                    Core

1. HCV1a consensus  MSTNPKPQRKTKRNTNRRPQDVKFPGGGQIVGGVYLLPRRGPRLGVRATRKTSERSQPRGRRQPIPKARRPEGRTWAQPGYPWPLY
2. HCV1b consensus  MSTNPKPQRKTKRNTNRRPQDVKFPGGGQIVGGVYLLPRRGPRLGVRATRKTSERSQPRGRRQPIPKARRPEGRAWAQPGYPWPLY
3. HCV2a Consensus  MSTNPKPQRKTKRNTNRRPQDVKFPGGGQIVGGVYLLPRRGPRLGVRATRKTSERSQPRGRRQPIPKDRRSTGKSWGKPGYPWPLY
4. HCV2b Consensus  MSTNPKPQRKTKRNTNRRPQDVKFPGGGQIVGGVYLLPRRGPRLGVRATRKTSERSQPRGRRQPIPKDRRSTGKSWGKPGYPWPLY
5. HCV 3 Consensus  MSTLPKPQRKTKRNTIRRPQDVKFPGGGQIVGGVYVLPRRGPRLGVRATRKTSERSQPRGRRQPIPKARRSEGRSWAQPGYPWPLY
6. HCV 4 Consensus  MSTNPKPQRKTKRNTNRRPMDVKFPGGGQIVGGVYLLPRRGPRLGVRATRKTSERSQPRGRRQPIPKARRSEGRSWAQPGYPWPLY
7. HCV5 consensus   MSTNPKPQRKTKRNTNRRPQDVKFPGGGQIVGGVYLLPRRGPRLGVRATRKTSERSQPRGRRQPIPKARRPTGRSWGQPGYPWPLY
8. HCV6 consensus   MSTLPKPQRKTKRNTNRRPMDVKFPGGGQIVGGVYLLPRRGPRLGVRATRKTSERSQPRGRRQPIPKARQPTGRHWAQPGYPWPLY
9. HCV7: ABN05226  MSTNPKPQRLTKRNTVRRPQNVKFPGGGQIVGGVYLLPRRGPRLGVRGTRKSSERSQPRGRRQRIPKAASSQGKAWGKPGYPWPLY
14. AVI1a-129       MSTNPKPQRKTKRNTNRRPQDVKFPGGGQIVGGVYLLPRRGPRLGVRATRKTSERSQPRGRRQPIPKARRPEGRTWAQPGYPWPLY
15. AVI3a-177       MSTLPKPQRKTKRNTIRRPQDVKFPGGGQIVGGVYVLPRRGPRLGVRATRKTSERSQPRERRQPIPKARRSDGRSWAQPGYPWPLY
                      90            100           110           120           130           140           150           160           170
Consensus           GNEGCGWAGWLLSPRGSRPSWGPTDPRRRSRNLGKVIDTLTCGFADLMGYIPLVGAPLGGVARALAHGVRVLEDGINYATGNLPGC
                    Core

1. HCV1a consensus  GNEGCGWAGWLLSPRGSRPSWGPTDPRRRSRNLGKVIDTLTCGFADLMGYIPLVGAPLGGAARALAHGVRVLEDGVNYATGNLPGC
2. HCV1b consensus  GNEGMGWAGWLLSPRGSRPSWGPTDPRRRSRNLGKVIDTLTCGFADLMGYIPLVGAPLGGAARALAHGVRVLEDGVNYATGNLPGC
3. HCV2a Consensus  GNEGLGWAGWLLSPRGSRPSWGPTDPRHRSRNVGKVIDTLTCGFADLMGYIPVVGAPLGGVARALAHGVRVLEDGVNYATGNLPGC
4. HCV2b Consensus  GNEGCGWAGWLLSPRGSRPTWGPTDPRHRSRNLGKVIDTITCGFADLMGYIPVVGAPVGGVARALAHGVRVLEDGINYATGNLPGC
5. HCV 3 Consensus  GNEGCGWAGWLLSPRGSRPSWGPNDPRRRSRNLGKVIDTLTCGFADLMGYIPLVGAPVGGVARALAHGVRALEDGINFATGNLPGC
6. HCV 4 Consensus  GNEGCGWAGWLLSPRGSRPSWGPNDPRRRSRNLGKVIDTLTCGFADLMGYIPLVGAPVGGVARALAHGVRAVEDGINYATGNLPGC
7. HCV5 consensus   ANEGLGWAGWLLSPRGSRPNWGPNDPRRKSRNLGKVIDTLTCGFADLMGYIPLVGGPVGGVARALAHGVRVLEDGINYATGNLPGC
8. HCV6 consensus   GNEGCGWAGWLLSPRGSRPHWGPNDPRRRSRNLGKVIDTLTCGFADLMGYIPVVGAPLGGVAAALAHGVRAIEDGINYATGNLPGC
9. HCV7: ABN05226  GNEGCGWAGWLLSPRGSRPTWGPTDPRHRSRNLGKVIDTMTCGFADLMGYIPVLGAPLGGVARALAHGVRVLEDGVNYATGNLPGC
14. AVI1a-129       GNEGCGWAGWLLSPRGSRPSWGPTDPRRRSRNLGKVIDTLTCGFADLMGYIPLVGAPLGGAARALAHGVRVLEDGVNYATGNLPGC
15. AVI3a-177       GNEGCGWAGWLLSPRGSRPSWGPNDPRRRSRNLGKVIDTLTCGFADLMGYIPIVGAPVGGVARALAHGVRALEDGINFATGNLPGC
                          180           190           200           210           220           230           240           250
Consensus           SFSIFLLALLSCLTVPASAYEVRNXSGLYHVTNDCPNSSIVYEADDAILHTPGCVPCVR-EGNTSRCWVXVTPTVAVRYXGAPTTS
                    Core              E1

1. HCV1a consensus  SFSIFLLALLSCLTVPASAYQVRNSTGLYHVTNDCPNSSIVYEAADAILHTPGCVPCVR-EGNASRCWVAVTPTVATRDGKLPTTQ
2. HCV1b consensus  SFSIFLLALLSCLTIPASAYEVRNVSGVYHVTNDCSNSSIVYEAADMIMHTPGCVPCVR-ENNSSRCWVALTPTLAARNASVPTTT
3. HCV2a Consensus  SFSIFLLALLSCITVPVSAAQVKNTSSSYMVTNDCSNDSITWQLQAAVLHVPGCVPCEKVGNNTSRCWIPVSPNVAVXQPGALTQG
4. HCV2b Consensus  SFSIFLLALLSCVTVPVSAVEVRNISSSYYATNDCSNNSITWQLTNAVLHLPGCVPCEN-DNGTLRCWIQVTPNVAVKHRGALTHN
5. HCV 3 Consensus  SFSIFLLALFSCLIHPAASLEWRNTSGLYVLTNDCSNSSIVYEADDVILHTPGCIPCVQTDGNTSTCWTPVTPTVAVKYVGATTAS
6. HCV 4 Consensus  SFSIFLLALLSCLTVPASAINYRNTSGIYHVTNDCPNSSIVYEADHHILHLPGCVPCVR-XGNQSRCWVALTPTVAAPYIGAPLES
7. HCV5 consensus   SFSIFXLALLSCLTVPXSAVPYRNASGVYHVTNDCPNSSIVYEAENLILHAPGCVPCVR-XGNVSRCWVQITPTLSAPSXGAVTAX
8. HCV6 consensus   SFSIFLLALLSCLTTPASAVHYXNSSGIYHLTNDCPNSSIVYEADAMILHLPGCVPCVR-VGNQSXCWVPVSPTLAVPNASTPATG
9. HCV7: ABN05226  SFSIFLLALLSCLTVPASAYEVRNSSGVYHLTNDCPNASIVYETDNAILHEPGCVPCVR-EGNTSRCWEPVAPTLAVRYRGALTDD
14. AVI1a-129       SFSIFLLALLSCLTVPASAYQVRNSTGLYHVTNDCPNSSIVYEAADAILHTPGCVPCVR-EGNTSRCWVAMTPTVATRDGKLPTTQ
15. AVI3a-177       SFSIFLLALLSCLIHPAASLEWRNTSGLYILTNDCPNSSIVYEADDVILHTPGCIPCVQ-DGNTSTCWTSVSPTVAVRYVGATTAS
```

FIG. 12A

| | 260–340 |
|---|---|
| Consensus | LRRHVDLLVGAATLCSALYVGDLCGAVFLVGQXFTFSPRRHWTVQDCNCSIYPGHITGHRMAWDMMMNWSPTTXLVXAQLLRIPQX |
| | E1 |
| 1. HCV1a consensus | LRRHIDLLVGSATLCSALYVGDLCGSVFLVGQLFTFSPRRHWTTQDCNCSIYPGHITGHRMAWDMMMNWSPTTALVVAQLLRIPQA |
| 2. HCV1b consensus | IRRHVDLLVGAAAFCSAMYVGDLCGSVFLVSQLFTFSPRRHETVQDCNCSIYPGHVSGHRMAWDMMMNWSPTTALVVSQLLRIPQA |
| 3. HCV2a Consensus | LRTHIDMVVMSATLCSALYVGDLCGGVMLAAQMFIVSPQHHWFVQECNCSIYPGTITGHRMAWDMMMNWSPTATMILAYAMRVPEV |
| 4. HCV2b Consensus | LRTHVDMIVMAATVCSALYVGDVCGAVMIVSQALIVSPERHNFTQECNCSIYQGHITGHRMAWDMMLNWSPTLTMILAYAARVPEL |
| 5. HCV 3 Consensus | IRSHVDLLVGAATMCSALYVGDMCGAVFLVGQAFTFRPRRHQTVQTCNCSLYPGHLSGHRMAWDMMMNWSPAVGMVVAHVLRLPQT |
| 6. HCV 4 Consensus | LRSHVDLMVGAATVCSALYIGDLCGGLFLVGQMFSFRPRRHWTTQDCNCSIYTGHITGHRMAWDMMMNWSPTTTLVLAQVMRIPST |
| 7. HCV5 consensus | LRRAVDYLAGGAALCSALYVGDACGAVXLVGQMFTYSPRXHTXVQDCNCSIYSGHITGHRMAWDMMMNWSPTTALXMAQLLRIPQV |
| 8. HCV6 consensus | FRRHVDLLVGAAAFCSALYIGDLCGGVFLVGQLFTFRPRRHQTVQDCNCSIYTGHVTGHRMAWDMMMNWSPTATLVLSSILRVPQL |
| 9. HCV7: ABN05226 | LRTHIDLVVASATLCSALYVGDICGAIFIASQAVLWKPGGGRIVQDCNCSIYPGHVTGHRMAWDMMQNWAPALSMVAAYAVRVPGV |
| 14. AVI1a-129 | LRRHIDLLVGSATLCSALYVGDLCGSVFLVGQMFTFSPRRHWTTQDCNCSLYPGHITGHRMAWDMMMNWSPTAALITAQLLRIPQA |
| 15. AVI3a-177 | IRSHVDLLVGAATLCSALYVGDMCGAVFLVGQAFTFRPRRHQTVQTCNCSLYPGHLTGHRMAWDMMMNWSPAVGMVVAHVLRMPQT |

| | 350–430 |
|---|---|
| Consensus | XLDIIAGAHWGVLAGLAYFSMQGNWAKVJXVLLLFAGVDAETHTTGGXAARTTSGLTSLFSPGPXQNLQLINTNGSWHINRTALNC |
| | E1 E2 |
| 1. HCV1a consensus | ILDMIAGAHWGVLAGIAYFSMVGNWAKVLVVLLLFAGVDAETHVTGGSAARTTSGLASLFTPGAKQNIQLINTNGSWHINRTALNC |
| 2. HCV1b consensus | VVDMVAGAHWGVLAGLAYYSMVGNWAKVLIVMLLFAGVDG-THVTGGAAARTTSGFTSLFSPGPSQKIQLINTNGSWHINRTALNC |
| 3. HCV2a Consensus | IIDIISGAHWGVMFGLAYFSMQGAWAKVVVILLLAAGVDAGTHTVGGSAAHTTSGLAGLFSXGXXQNIQLINTNGSWHINRTALNC |
| 4. HCV2b Consensus | VLEVVFGGHWGVVFGLAYFSMQGAWAKVIAILLLVAGVDATTYSSGAQAGRTTSGFAGLFSPGPKQNIQLINTNGSWHINRTALNC |
| 5. HCV 3 Consensus | LFDIIAGAHWGILAGLAYYSMQGNWAKVAIIMVMFSGVDAXTHTTGGSAARGARGLTSLFSVGPXQNLQLVNTNGSWHINRTALNC |
| 6. HCV 4 Consensus | LVDLLAGGHWGVLVGVAYFSMQANWAKVILVLFLFAGVDAETHVSGGAAGRTTXGLTSLFSPGXQQNLQLINSNGSWHINRTALNC |
| 7. HCV5 consensus | VIDIIAGAHWGVLFAAAYFASXANWAKVILVLFLFAGVDAXTXTVGGXAGQGXXXLTSFFXPGPQQNLQLINTNGSWHINRTALNC |
| 8. HCV6 consensus | LLDIFLGGHWGVLGAVLYYSMVANWAKVLAVLLLFAGVDATT-TTGXAAGRTTSGLTXLFXPGAKQNLQLINTNGSWHINRTALNC |
| 9. HCV7: ABN05226 | IITTVAGGHWGVLFGLAYFGMAGNWAKVILIMLLMSGVDAETMAVGARAAHTTGALVSLLNPGPSQRLQLINTNGSWHINRTALNC |
| 14. AVI1a-129 | ILDMIAGAHWGVLAGIAYFSMVGNWAKVLVVLLLFAGVDAQTHVTGGRAAHITAGLTSLFSPGPSQKLQLVNTNGSWHINSTALNC |
| 15. AVI3a-177 | VFDIIAGAHWGILAGLAYYSMQGNWAKVAIIMVMFSGVDAETHTTGGTAARNAFTLTGLFTQGARQKLQLINTNGSWHINRTALNC |

| | 440–510 |
|---|---|
| Consensus | NDSLXTGFIAGLFYTHKFNSSGCPERLASCRPLTDFDQGWGPLTYANXISGPSDDRPYCWHYPPRPCGIVPARSVCGPVYCFTP-- |
| | E2 |
| 1. HCV1a consensus | NDSLNTGWLAGLFYYHKFNSSGCPERLASCRPLTDFDQGWGPISYANG-SGP-DQRPYCWHYPPKPCGIVPAKSVCGPVYCFTP-- |
| 2. HCV1b consensus | NDSLQTGFLAALFYTHKFNSSGCPERMASCRPIDKFAQGWGPITYA---EPSSDQRPYCWHYAPRPCGIVPASQVCGPVYCFTP-- |
| 3. HCV2a Consensus | NDSLNTGFLASLFYTHRFNSSGCPERLSACRNIEAFRIGWGTLQYEDNVTNPEDMRPYCWHYPPKQCGIVPARSVCGPVYCFTP-- |
| 4. HCV2b Consensus | NDSLQTGFIASLFYTNNFNSSGCPERLSSCRGLDDFRIGWGTLEYETNVTNDEDMRPYCWHYPPKPCGIVSARTVCGPVYCFTP-- |
| 5. HCV 3 Consensus | NDSINTGFIAGLFYYHKFNSTGCPQRLSSCKPITFFRQGWGPLTDANNITGPSDDKPYCWHYAPRPCDVVPASSVCGPVYCFTPHH |
| 6. HCV 4 Consensus | NDSLNTGFLASLFYTHKFNSSGCPERLASCKSLDSFDQGWGPLGVANNISGPSDDRPYCWHYPPRPCGIVPASSVCGPVYCFTP-- |
| 7. HCV5 consensus | NDSLQTGFIAGLXYXHKFNSSGCPQRMASCRPLAAFDQGWGTISYAX-VSGPSDDKPYCWHYPPRPCGVVPARXVCGPVYCFTP-- |
| 8. HCV6 consensus | NDSLQTGFIAGLFYTHKFNSSGCPERMSSCKPLTDFDQGWGPITYAN-ISGPSEDRPYCWHYAPRPCDVVPARTVCGPVYCFTP-- |
| 9. HCV7: ABN05226 | NDSLQTGFIAALFYTHRFNSSGCPERMASCKPLSDFDQGWGPLWY-NSTERPSDQRPYCWHYAPSPCGIVPAKDVCGPVYCFTP-- |
| 14. AVI1a-129 | NDSLKTGWIAGLLYSYKFNSSGCPERLASCRRLTDFAQGWGPISHANG-SGP-DERPYCWHYPPRPCGIVPAKSVCGPVYCFTP-- |
| 15. AVI3a-177 | NESLNTGFIAGLFYLHKFNSTGCPERLSSCKPITFFRQGWGSLTDAN-ITGPSDDKPYCWHYAPRPCEVVPALNVCGPVYCFTP-- |

FIG. 12B

```
                     520       530       540       550       560       570       580       590       600
Consensus            SPVVVGTTDRXGVPTYTWGENETDVFLLNSTRPPQGNWFGCTWMNST-GFTKTCGAPPCNI-GGGGN-----NDLLCPTDCFRKHP
                     E2

1. HCV1a consensus   SPVVVGTTDRSGAPTYNWGENDTDVFVLNNTRPPLGNWFGCTWMNST-GFTKVCGAPPCVI-GGVGN-----NTLHCPTDCFRKHP
2. HCV1b consensus   SPVVVGTTDRFGVPTYSWGENETDVLLLNNTRPPQGNWFGCTWMNST-GFTKTCGGPPCNI-GGVGN-----NTLTCPTDCFRKHP
3. HCV2a Consensus   SPVVVGTTDRLGVPTYTWGENETDVFLLNSTRPPQGSWFGCTWMNST-GFTKTCGAPPCRI-RADFNAS---TDLLCPTDCFRKHP
4. HCV2b Consensus   SPVVVGTTDRQGVPTYSWGENETDVFLLNSTRPPQGAWFGCTWMNGT-GFTKTCGAPPCRI-RRDYNST---LDLLCPTDCFRKHP
5. HCV 3 Consensus   SPVVVGTTDAKGVPTYTWGENETDVFLLESLRPPSGRWFGCTWMNSTRGFVKTCGAPPCNIYGGGGNPXNNESDLFCPTDCFRKHP
6. HCV 4 Consensus   SPVVVGTTDRLGVPTYTWGENESDVFLLNSTRPPQGAWFGCVWMNST-GFTKACGAPPCEVRTNNGTS----TDWPCPTDCFRKHP
7. HCV5 consensus    SPVVVGTTDRXGXPTYXWGXNETDIFLLNNTRPPXGNWFGCTWMNST-GFVKTCGAPPCNL-GPTGN-----NSLKCPTDCFRKHP
8. HCV6 consensus    SPVVVGTTDRRGLPTYTWGENETDVFLLESLRPPTGGWFGCTWMNST-GFVKTCGAPPCNIXPNSSN-----NSLLCPTDCFRKHP
9. HCV7: ABN05226   SPVVVGTTDRRGVPTYTWGENESDVFLLNSTRPPQGSWFGCSWMNTT-GFTKTCGGPPCKIRPQGAQSN---TSLTCPTDCFRKHP
14. AVI1a-129        SPVVVGTTDKSGAPTYNWGENDWDVFVLNNTRPPLGNWFGCTWMNST-GFTKVCGAPPCVI-GGAGN-----NTLRCPTDCFRKHP
15. AVI3a-177        SPVVVGTTDRQGVPTYTWGENETDVFLLRSLRPPSGQWFGCTWMNST-GFVKTCGAPPCDIYGGGGNRCN-ESDLFCPTDCFRKHP

                           610       620       630       640       650       660       670       680
Consensus            EATYSXCGSGPWLTPRCLVDYPYRLWHYPCTVNFTIFKVRMYVGGVEHRLEAACNWTRGERCDLEDRDRSELSPLLHSTTEWAILP
                     E2

1. HCV1a consensus   EATYSRCGSGPWITPRCLVDYPYRLWHYPCTINYTIFKVRMYVGGVEHRLEAACNWTRGERCDLEDRDRSELSPLLLSTTQWQVLP
2. HCV1b consensus   EATYTKCGSGPWLTPRCLVDYPYRLWHYPCTVNFTIFKVRMYVGGVEHRLNAACNWTRGERCDLEDRDRSELSPLLLSTTEWQILP
3. HCV2a Consensus   EATYIKCGSGPWLTPRCLVDYPYRLWHYPCTVNYTIFKIRMYVGGVEHRLTAACNFTRGDRCNLEDRDRSQLSPLLHSTTEWAILP
4. HCV2b Consensus   DATYLKCGAGPWLTPRCLVDYPYRLWHYPCTVNFTIFKVRMYVGGVEHRLSAACNFTRGDRCRLEDRDRGQQSPLLHSTTEWAVLP
5. HCV 3 Consensus   EATYSRCGAGPWLTPRCMVDYPYRLWHYPCTVNFTLFKVRMFVGGFEHRFTAACNWTRGERCDIEDRDRSEQHPLLHSTTELAILP
6. HCV 4 Consensus   ETTYAKCGSGPWITPRCLIHYPYRLWHYPCTVNFTVFKIRTFIGGIEHRMEAACNWTRGEVCGLEHRDRAELSPLLLSTTTWQXLP
7. HCV5 consensus    DATYTKCGSGPWLTPRCLVHYPYRLWHYPCTVNYTIFKVRMFIGGLEHRLEAACNWTRGERCDLEDRDRAELSPLLHTTTQWAILP
8. HCV6 consensus    EATYARCGSGPWLTPRCLVDYPYRLWHYPCTVNFTIHKVRMFVGGVEHRFDAACNWTRGERCELDDRDRIEMSPLLFSTTELAILP
9. HCV7: ABN05226   RATYSACGSGPWLTPRCMVHYPYRLWHYPCTVNFTIHKVRLYIGGVEHRLDAACNWTRGERCDLEDRDRVDMSPLLHSTTELAILP
14. AVI1a-129        DATYSRCGSGPWITPRCLVDYPYRLWHYPCTVNYSIFKIRMYLGGVEHRLEAACNWTRGERCDLEDRDRSELSPLLLSTTQWQVLP
15. AVI3a-177        EATYSRCGAGPWLTPRCLVDYPYRLWHYPCTVNFTLFKVRMFVGGFEHRFTAACNWTRGERCNIEDRDRSEQHPLLHSTTELAILP

                     690       700       710       720       730       740       750       760       770
Consensus            CSFTTLPALSTGLIHLHQNIVDVQYLYGVGSAVVSWAXKWEYVVLLFLLLADARVCACLWMMLLISQAEAALENLVVLNAASAAGT
                     E2                                                                          P7

1. HCV1a consensus   CSFTTLPALSTGLIHLHQNIVDVQYLYGVGSSIASWAIKWEYVVLLFLLLADARVCSCLWMMLLISQAEAALENLVVLNAASLAGT
2. HCV1b consensus   CSFTTLPALSTGLIHLHQNIVDVQYLYGIGSAVVSFAIKWEYVLLLFLLLADARVCACLWMMLLIAQAEAALENLVVLNAASVAGA
3. HCV2a Consensus   CSYSDLPALSTGLLHLHQNIVDVQYMYGLSPALTKYVVRWEWVVLLFLLLADARVCACLWMLILLGQAEAALEKLVVLHAASAASC
4. HCV2b Consensus   CSFSDLPALSTGLLHLHQNIVDVQYLYGLSPAITRYIVKWEWVVLLFLLLADARVCACLWMLIILGQAEAALEKLIILHSASAASA
5. HCV 3 Consensus   CSFTPMPALSTGLIHLHQNIVDVQYLYGVGSGMVGWALKWEFVILVFLLLADARVCVALWLMLMISQAEAALENLVTLNAVAAAGT
6. HCV 4 Consensus   CSFTTLPALSTGLIHLHQNIVDVQYLYGVGSAVVSWALKWEYVVLAFLLLADARVSACLWMMFMVSQVEAALSNLININAASAAGT
7. HCV5 consensus    CSFTPTPALSTGLIHLHQNIVDTQYLYGLSSSIVSWAVKWEYIVLXFLLLADARICTCLWILLLXCQAEAALENVIVLNAAAAAGX
8. HCV6 consensus    CSFTTMPALSTGLIHLHQNIVDVQYLYGVSSSVVSWAVKWEYVVLAFLVLADARICACLWLMLLIGQAEAALENLIVLNAASAAST
9. HCV7: ABN05226   CSFVPLPALSTGLIHLHQNIVDAQYLYGLSPAIISWAIRWEWVVLVFLLLADARICACLWMMMLMAQAEAALENLIHLNAASLAGT
14. AVI1a-129        CSFTTLPALSTGLIHLHQNIVDVQYLYGVGSSVASWAIKWDYVVLLFLLLADARICSCLWMMLLISQAEAALENLVVLNAASLAGT
15. AVI3a-177        CSFTPMPALSTGLIHLHQNIVDVQYLYGVGSGVVGWALRWEFVVLVFLLLADARVCVALWLMLMISQAEAALENLVTLNAVAAAGT
```

FIG. 12C

```
                     780       790       800       810       820       830       840       850       860
Consensus            HGIXWFLVFFCAAWYLK--GRLVPXATYALXGLWPLLLLLLALPQRAYALDREVAASLGXAVLVXLTIFTLSPHYKHLLSRXLWWL
                     P7                                                  NS2

1. HCV1a consensus   HGLVSFLVFFCFAWYLK--GRWVPGAAYALYGMWPLLLLLLALPQRAYALDTEVAASCGGVVLVGLMALTLSPYYKRYISWCLWWL
2. HCV1b consensus   HGILSFLVFFCAAWYIK--GRLVPGAAYAFYGVWPLLLLLLALPPRAYAMDREMAASCGGAVFVGLALLTLSPHYKVFLARLIWWL
3. HCV2a Consensus   NGFLYFVIFFVAAWYIK--GRAVPLAAYSLTGLWPFCLLLLALPQQAYAYDASVHGQIGAALLILITLFTLTPGYKTLLSRCLWWL
4. HCV2b Consensus   NGPLWFFIFFTAAWYLK--GRVVPVATYSVLGLWSFLLLVLALPQQAYALDAAEQGELGLVILVIISIFTLTPAYKILLSRSVWWL
5. HCV 3 Consensus   HGIGWYLVAFCAAWHVRRAGKLVPLVTYSLTGLWSLALLVLLLPQRAYAWSGEDSATLGAGILVLFGFFTLSPWYKHWIGRLMWWN
6. HCV 4 Consensus   HGFWYAIFFICIAWHVK--GRLPAAATYAACGMWPLLLLLLMLPERAYAYDREVAGSLGGAVVVALTILTLSPHYKSWLARGLWWI
7. HCV5 consensus    HGFFWGLLVXCXAWHXK--GRLVPGATYLCLGXWPLLLLLLLLPQRALALDSSDGGTVGCLVLXILTIFTLTPGYKKXVVLVXWWL
8. HCV6 consensus    QGWWWGLLFLCCAWYVK--GRLVPACTYALLQLWPLLLLVLALPRRAYAYDNEQAASLGALVLLVITIFTLTPAYKQLLVSFLWWN
9. HCV7: ABN05226   HGIWWLLLVFCASWHLR--GRVVPLVTYGICGMWPFFLMLLSLPPRAYALDREVSAALGTGMLAIILLVTLGPHYKRLLALILWWV
14. AVI1a-129        HGLAPFLVFFCLAWYLK--GKWAPGAVYAVYGMWPLLLLLLALPQRAYALDTEVAASCGGAVLVGLMVLTLSPHYKHYISWCLWWL
15. AVI3a-177        HGIGWYLVAFCAAWHLR--GKLVPLVTYSLTGLWSLAVLVLLLPQRAYAWSGEDSATLGAGILVLFGFFTLSPWYKHWIGRLMWWN

                     870       880       890       900       910       920       930       940
Consensus            QYFITRAEAXLQVWVPPLNVRGGRDXXILLTCLLHPXLVFDITKLLLAVLGPLYLLQASLLRVPYFVRAHALLRXCMLVRXLAGGK
                     NS2

1. HCV1a consensus   QYFLTRVEAQLHVWVPPLNVRGGRDAVILLMCVVHPTLVFDITKLLLAVFGPLWILQASLLKVPYFVRVQGLLRICALARKMAGGH
2. HCV1b consensus   QYFITRAEAHLQVWIPPLNVRGGRDAIILLTCAVHPELIFDITKLLLAILGPLMVLQAGITRVPYFVRAQGLIRACMLVRKVAGGH
3. HCV2a Consensus   CYLLTLGEAMVQEWAPPMQARGGRDGIIWAATIFCPGVVFDITKWLLAVLGPAYLLRDALTRVPYFVRAHALLRMCTMVRHLAGGR
4. HCV2b Consensus   SYMLVLAEAQIQQWVPPLEARGGRDGIIWVAVILHPRLVFEVTKWLLAILGPAYLLKASLLRVPYFVRAHALLRVCTLVRHLAGAR
5. HCV 3 Consensus   QYTICRCEAALQVWVPPLLARGSRDGVILLTSLLYPSLIFDITKLLIAVLGPLYLIQAAITTTPYFVRAHVLVRLCMLVRSVMGGK
6. HCV 4 Consensus   QYFIARAEALLHVYVPSFDVRGPRDSLIILAVLACPHLVFDITKYLLAILGPLYILQASLLRVPYFVRAHALVKICSLLRGVVYGK
7. HCV5 consensus    QYFIARVEAXIHVWVPPLQVRGGRDAIIMLTCLFHPALGFEVTKILLGILGPLYLLQXSLXKVPYFXRARALLRACLLAKHLVXGK
8. HCV6 consensus    QYFIARAEAMLHVWVPSLRVRGGRDAVILLTCLLHPQLGFEVTKILLALLGPLYLLQYSLLKVPYFVRAHILLRACLLVRRLAGGK
9. HCV7: ABN05226   TYFLTRCEAALQTWVPPLNPRGGRDGFILCVLLCYPGLVFDITKWLLVMMCPLYLLQLCLVRTPYFVRAQALIRVCSLFKTLAGGR
14. AVI1a-129        QYFLTRAEAQLHVWVPPLNVRGGRDAVILLMCVVHPTLVFDITKLLLAV?GPLWILQTSLLKVPYFVRVQGLLRICALARKIAGGH
15. AVI3a-177        QYTICRCEAALQVWVPPLLARGSRDGAILLTSLLYPSLIFDITKLLIAVLGPLYLIQAAITTTPYFVRAHVLVRLCMLVRSVMGGK

                     950       960       970       980       990       1,000     1,010     1,020     1,030
Consensus            YVQMALLKLGRWTGTYIYDHLXPLSDWAAAGLRDLAVAVEPVIFSPMEKKVITWGADTAACGDILCGLPVSARLGREILLGPADDY
                     NS2

1. HCV1a consensus   YVQMAIIKLGALTGTYVYNHLTPLRDWAHNGLRDLAVAVEPVVFSQMETKLITWGADTAACGDIINGLPVSARRGREILLGPADGM
2. HCV1b consensus   YVQMAFMKLAALTGTYVYDHLTPLRDWAHAGLRDLAVAVEPVVFSDMETKIITWGADTAACGDIILGLPVSARRGREILLGPADSL
3. HCV2a Consensus   YVQMALLALGRWTGTYIYDHLTPMSDWAASGLRDLAVAVEPIIFSPMEKKVIVWGAETAACGDILHGLPVSARLGREILLGPADGY
4. HCV2b Consensus   YIQMLLITIGRWTGTYIYDHLSPLSTWAAQGLRDLAVAVEPVVFSPMEKKVIVWGAETVACGDILHGLPVSARLGREVLLGPADSY
5. HCV 3 Consensus   YFQMIILSIGRWFNTYLYDHLAPMQHWAAAGLKDLAVATEPVIFSPMEIKVITWGADTAACGDILCGLPVSARLGREVLLGPADDY
6. HCV 4 Consensus   YCQMAVLKVGALTGTYIYDHLTPLSDWAAEGLRDLAVALEPVVFTPMEKKVIVWGADTAACGDIIXGLPVSARLGNEILLGPADSE
7. HCV5 consensus    YVQAALLHLGRLTGTYIYDHLAPMKDWAASGLRDLAVATEPIIFSPMETKVITWGADTAACGDILAGLPVSARRGREIFLGPADDI
8. HCV6 consensus    YVQACLLRLGAWTGTYIYDHLAPLSDWASDGLRDLAVAVEPVIFSPMEKKVITWGADTAACGDILAGLPVSARRGNLVLLGPADDM
9. HCV7: ABN05226   YVQAALLTIGRWTGTYIYNHLAPLETWAAGGLRDLAVAVEPVIFSPMEKKIIVWGAETTACGDILCGLPVSARLGREVLLGPADDY
14. AVI1a-129        YVQMAIIKLGALTGTYIYDHLTPLRDWAHNGLRDLAVAVEPVVFSRMETKLITWGADTAACGDIINGLPVSARRGQEILLGPADGM
15. AVI3a-177        YFQMIILSIGRWFNTYLYDHLAPMQHWAAAGLKDLAVATEPVIFSPMEIKVITWGADTAACGDILCGLPVSARLGHEVLLGPADDY
```

FIG. 12D 1,040 1,050 1,060 1,070 1,080 1,090 1,100 1,110

Consensus XSKGWRLLAPITAYAQQTRGLLGTIVTSLTGRDKNEVEGEVQVLSTATQTFLGTCINGVMWTVYHGAGSKTLAGPKGPVXQMYTNV

NS2 NS3

1. HCV1a consensus VSKGWRLLAPITAYAQQTRGLLGCIITSLTGRDKNQVEGEVQIVSTAAQTFLATCINGVCWTVYHGAGTRTIASPKGPVIQMYTNV
2. HCV1b consensus EGQGWRLLAPITAYSQQTRGLLGCIITSLTGRDKNQVEGEVQVVSTATQSFLATCVNGVCWTVYHGAGSKTLAGPKGPITQMYTNV
3. HCV2a Consensus TSKGWRLLAPITAYAQQTRGLLGAIVVSMTGRDKTEQAGEIQVLSTVTQSFLGTSISGVLWTVYHGAGNKTLAGSRGPVTQMYSSA
4. HCV2b Consensus TSKGWKLLAPITAYTQQTRGLLGAIVVSLTGRDKNEQAGQVQVLSSVTQSFLGTSISGVLWTVYHGAGNKTLAGPKGPVTQMYTSA
5. HCV 3 Consensus REMGWRLLAPITAYAQQTRGLLGTIVTSLTGRDKNVVTGEVQVLSTATQTFLGTTVGGVMWTVYHGAGSRTLAGAKHPALQMYTNV
6. HCV 4 Consensus TSKGWRLLAPITAYAQQTRGLFSTIITSLTGRDTNENCGEVQVLSTATQSFLGTAVNGVMWTVYHGAGSKTISGPKGPVNQMYTNV
7. HCV5 consensus XXAGWRLLAPITAYAQQTRGVLGAIVVSLTGRDKNEAEGEVQVLSTATQTFLGTCINGVMWTVFHGAGXKTLAGPKGPVVQMYTNV
8. HCV6 consensus KRGGWRLLAPITAYAQQTRGLLGTIVTSLTGRDKNEVEGEVQVVSTATQSFLATSINGVLWTVYHGAGSKTLAGPKGPVCQMYTNV
9. HCV7: ABN05226 RSMGWQLLAPISAYAQQTRGLISTLVVSLTGRDKNETAGEVQVLSTSTQTFLGTNVGGVMWGPYHGAGTRTVAGRGGPVLQMYTSV
14. AVI1a-129 VSKGWRLLAPITAYAQQTRGLLGCIITSLTGRDKNQVEGEVQIVSTAAQTFLATCINGVCWTVYHGAGTRTIASPKGPVIQMYTNV
15. AVI3a-177 REMGWRLLAPITAYAQQTRGLLGTIVTSLTGRDKNVVTGEVQVLSTATQTFLGTTIGGVMWTVYHGAGSRTLAGVKHPALQMYTNV 1,120 1,130 1,140 1,150 1,160 1,170 1,180 1,190 1,200

Consensus DQDLVGWPAPPGAKSLTPCTCGSSDLYLVTRHADVIPXRRRGDSRGSLLSPRPISXLKGSSGGPVLCPSGHAVGIFRAAVCTRGVA

NS3

1. HCV1a consensus DQDLVGWPAPQGARSLTPCTCGSSDLYLVTRHADVIPVRRRGDSRGSLLSPRPISYLKGSSGGPLLCPAGHAVGIFRAAVCTRGVA
2. HCV1b consensus DQDLVGWQAPPGARSLTPCTCGSSDLYLVTRHADVIPVRRRGDSRGSLLSPRPVSYLKGSSGGPLLCPSGHAVGIFRAAVCTRGVA
3. HCV2a Consensus EGDLVGWPSPPGTKSLEPCTCGAVDLYLVTRNADVIPARRRGDKRGALLSPRPLSTLKGSSGGPVLCPRGHAVGIFRAAVCSRGVA
4. HCV2b Consensus EGDLVGWPSPPGTKSLDPCTCGAVDLYLVTRNADVIPVRRKDDRRGALLSPRPLSTLKGSSGGPVLCPRGHAVGLFRAAVCARGVA
5. HCV 3 Consensus DQDLVGWPAPPGAKSLEPCACGSADLYLVTRDADVIPARRRGDSTASLLSPRPLACLKGSSGGPVMCPSGHVAGIFRAAVCTRGVA
6. HCV 4 Consensus DQDLVGWPAPPGVKSLAPCTCGASDLYLVTRHADVVPVRRRGDTRGALLSPRPISTLKGSSGGPLLCPMGHAAGIFRAAVCTRGVA
7. HCV5 consensus DKDLVGWPXPPGXRSLTPCTCGSADLYLVTRHADVIPARRRGDTRASLLSPRPISYLKGSSGGPIMCPSGHVVGVFRAAVCTRGVA
8. HCV6 consensus DQDLVGWPAPPGARSLTPCTCGSSDLYLVTRNADVIPARRRGDTRAALLSPRPISTLKGSSGGPILCPSGHVVGLFRAAVCTRGVA
9. HCV7: ABN05226 SDDLVGWPAPPGSKSLEPCSCGSADLYLVTRNADVLPLRRKGDGTASLLSPRPVSSLKGSSGGPVLCPQSHCVGIFRAAVCTRGVA
14. AVI1a-129 DKDLVGWPAPPGSRSLTPCTCGSSDLYLVTRHADVIPVRRRGDSRGSLLSPRPISYLKGSSGGPLLCPAGHAVGIFRAAVCTRGVA
15. AVI3a-177 DQDLVGWPAPPGAKSLEPCSCGSTDLYLVTREADVIPARRRGDSTASLLSPRPLACLKGSSGGPVMCPSGHVAGIFRAAVCTRGVA 1,210 1,220 1,230 1,240 1,250 1,260 1,270 1,280 1,290

Consensus KAVDFIPVESLETTMRSPXFTDNSTPPAVPQXYQVGYLHAPTGSGKSTKVPAAYAAQGYKVLVLNPSVAATLGFGAYMSKAHGIDP

NS3

1. HCV1a consensus KAVDFIPVENLETTMRSPVFTDNSSPPAVPQSFQVAHLHAPTGSGKSTKVPAAYAAQGYKVLVLNPSVAATLGFGAYMSKAHGIDP
2. HCV1b consensus KAVDFVPVESMETTMRSPVFTDNSSPPAVPQTFQVAHLHAPTGSGKSTKVPAAYAAQGYKVLVLNPSVAATLGFGAYMSKAHGVDP
3. HCV2a Consensus KSIDFIPVETLDIVTRSPTFSDNSTPPAVPQTYQVGYLHAPTGSGKSTKVPVAYAAQGYKVLVLNPSVAATLGFGAYLSKAHGINP
4. HCV2b Consensus KSIDFIPVESLDIATRTPSFSDNSTPPAVPQSYQVGYLHAPTGSGKSTKVPAAYASQGYKVLVLNPSVAATLGFGAYMSKAHGINP
5. HCV 3 Consensus KALQFIPVETLSTQARSPSFSDNSTPPAVPQSYQVGYLHAPTGSGKSTKVPAAYVAQGYNVLVLNPSVAATLGFGSFMSRAYGIDP
6. HCV 4 Consensus KAVDFVPVESLETTMRSPVFTDNSTPPAVPQTYQVAHLHAPTGSGKSTKVPAAYAAQGYKVLVLNPSVAATLGFGAYMSKAYGIDP
7. HCV5 consensus KALDFIPVENLETTMRSPVFTDNSTPPAVPHEFQVGHLHAPTGSGKSTKVPAAYAAQGYKVLVLNPSVAATLGFGAYMSRAYGVDP
8. HCV6 consensus KSLDFVPVENMETTMRSPSFTDNSTPPAVPQTYQVGYLHAPTGSGKSTKVPAAYASQGYKVLVLNPSVAATLGFGSYMSKAHGIDP
9. HCV7: ABN05226 KAVQFVPIEKMQVAQRSPSFSDNSTPPAVPSTYQVGYLHAPTGSGKSTKVPAAYASQGYKVLVLNPSVAATLGFGAYMSKAYGIDP
14. AVI1a-129 KAVDFIPVESLETTMRSPVFTDNSSPPVVPQSFQVAHLHAPTGSGKSTKVPAAYAAQGYKVLVLNPSVAATL?FGAYMSKAHGVDP
15. AVI3a-177 KALQFIPVETLSAQARSPSFSDNSTPPIVPQSYQVGYLHAPTGSGKSTKVPAAYVAQGYNVLVLNPSVAATLGFGSFMSRAYGIDP

FIG. 12E

```
                      1,300     1,310     1,320     1,330     1,340     1,350     1,360     1,370
Consensus             NIRTGVRTVTTGAPITYSTYGKFLADGGCSGGAYDIIICDECHSTDATTILGIGTVLDQAETAGVRLVVLATATPPGSVTVPHPNI
                      NS3

1. HCV1a consensus    NIRTGVRTITTGSPITYSTYGKFLADGGCSGGAYDIIICDECHSTDATSILGIGTVLDQAETAGARLVVLATATPPGSVTVPHPNI
2. HCV1b consensus    NIRTGVRTITTGAPITYSTYGKFLADGGCSGGAYDIIICDECHSTDSTTILGIGTVLDQAETAGARLVVLATATPPGSVTVPHPNI
3. HCV2a Consensus    NIRTGVRTVTTGEAITYSTYGKFLADGGCAGGAYDIIICDECHAVDATTILGIGTVLDQAETAGVRLTVLATATPPGSVTTPHPNI
4. HCV2b Consensus    NIRTGVRTVTTGDPITYSTYGKFLADGGCSAGAYDVIICDECHSVDATTILGIGTVLDQAETAGARLVVLATATPPGTVTTPHSNI
5. HCV 3 Consensus    NIRTGNRTVTTGAKLTYSTYGKFLADGGCSGGAYDVIICDECHAQDATSILGIGTVLDQAETAGVRLTVLATATPPGSITVPHSNI
6. HCV 4 Consensus    NIRSGVRTITTGAPITYSTYGKFLADGGCSGGAYDIIICDECHSTDSTTILGIGTVLDQAETAGVRLVVLATATPPGSVTTPHSNI
7. HCV5 consensus     NIRTGVRTVTTGAAITYSTYGKFLADGGCSGGAYDVIICDECHSQDATTILGIGTVLDQAETAGARLVVLATATPPGSVTTPHPNI
8. HCV6 consensus     NIRTGVRTITTGGAITYSTYGKFLADGGCSGGAYDIIICDECHSTDPTTVLGIGTVLDQAETAGVRLTVLATATPPGSVTVPHPNI
9. HCV7: ABN05226     SVRTGARTVTTGAPITYSTYGKFLADGGCSGGAYDIIICDECHAIDATTVVGIGTVLDQAETSGVRLVVLATATPPGSVTVPHPNI
14. AVI1a-129          NIRTGVRTITTGSPITYSTYGKFLADGGCSGGAYDIIICDECHSTDATSILGIGTVLDQAETAGARLVVLATATPPGSVTVPHPNI
15. AVI3a-177          NIRTGNRTVTTGAKLTYSTYGKFLADGGCSGGAYDVIICDECHAQDATSILGIGTVLDQAETAGVRLTVLATATPPGSITVPHSNI

                      1,380     1,390     1,400     1,410     1,420     1,430     1,440     1,450     1,460
Consensus             EEVALGTXGEIPFYGKAIPLEXIKGGRHLIFCHSKKKCDELAAKLXGLGLNAVAYYRGLDVSVIPTSGDVVVVATDALMTGFTGDF
                      NS3

1. HCV1a consensus    EEVALSTTGEIPFYGKAIPLEVIKGGRHLIFCHSKKKCDELAAKLVALGINAVAYYRGLDVSVIPTSGDVVVVATDALMTGFTGDF
2. HCV1b consensus    EEVALSNTGEIPFYGKAIPIETIKGGRHLIFCHSKKKCDELAAKLSGLGLNAVAYYRGLDVSVIPTSGDVVVVATDALMTGFTGDF
3. HCV2a Consensus    EEVALGQEGEIPFYGRAIPLSYIKGGRHLIFCHSKKKCDELAAALRGMGLNAVAYYRGLDVSIIPTQGDVVVVATDALMTGYTGDF
4. HCV2b Consensus    EEVALGHEGEIPFYGKAIPLAFIKGGRHLIFCHSKKKCDELAAALRGMGVNAVAYYRGLDVSVIPTQGDVVVVATDALMTGYTGDF
5. HCV 3 Consensus    EEVALGSEGEIPFYGKAIPIAQLKGGRHLIFCHSKKKCDEIASKLRGMGLNAVAYYRGLDVSVIPTTGDVVVCATDALMTGFTGDF
6. HCV 4 Consensus    EEVALPTTGEIPFYGKAIPLELIKGGRHLIFCHSKKKCDELAKQLTSLGLNAVAYYRGLDVSVIPTSGDVVVCATDALMTGFTGDF
7. HCV5 consensus     EEVALPSEGEIPFYGRAIPLXLIKGGRHLIFCHSKKKCDELAKQLTSLGVNAVAYYRGLDVAVIPATGDVVVCSTDALMTGFTGDF
8. HCV6 consensus     TETALPTTGEIPFYGKAIPLEYIKGGRHLIFCHSKKKCDELAKQLTSLGLNAVAFYRGVDVSVIPTSGDVVVCATDALMTGYTGDF
9. HCV7: ABN05226     EEVALGNDGEIPFYGKAIPLQHIKGGRHLIFCHSKKKCDELAGKLTSLGLTAVAYYRGLDVSVIPTSGDVVVVATDALMTGFTGDF
14. AVI1a-129          EEVALSTTGEIPFYGKAIPLEVIKGGRHLIFCHSKKKCDELAAKLVALGINAVAYYRGLDVSVIPTSGDVVVVATDALMTGYTGDF
15. AVI3a-177          EEVALGSEGEIPFYGKAIPLAQLKGGRHLIFCHSKKKCDEMASKLRGMGLNAVAYYRGLDVSVIPTAGDVVVCATDALMTGFTGDF

                      1,470     1,480     1,490     1,500     1,510     1,520     1,530     1,540
Consensus             DSVIDCNVAVTQTVDFSLDPTFTIETTTVPQDAVSRSQRRGRTGRGRLGIYRYVSPGERPSGMFDSVVLCECYDAGCAWYELTPAE
                      NS3

1. HCV1a consensus    DSVIDCNTCVTQTVDFSLDPTFTIETTTLPQDAVSRTQRRGRTGRGKPGIYRFVAPGERPSGMFDSSVLCECYDAGCAWYELTPAE
2. HCV1b consensus    DSVIDCNTCVTQTVDFSLDPTFTIETTTVPQDAVSRSQRRGRTGRGRRGIYRFVTPGERPSGMFDSSVLCECYDAGCAWYELTPAE
3. HCV2a Consensus    DSVIDCNVAVTQVVDFSLDPTFTITTQTVPQDAVSRSQRRGRTGRGRLGIYRYVSTGERASGMFDSVVLCECYDAGAAWYELTPAE
4. HCV2b Consensus    DSVIDCNVAVTQIVDFSLDPTFTITTQTVPQDAVSRSQRRGRTGRGRLGIYRYVSSGERPSGMFDSVVLCECYDAGAAWYELTPAE
5. HCV 3 Consensus    DSVIDCNVAVEQYVDFSLDPTFSIETRTAPQDAVSRSQRRGRTGRGRLGTYRYVTPGERPSGMFDSVVLCECYDAGCSWYDLQPAE
6. HCV 4 Consensus    DSVIDCNTSVIQTVDFSLDPTFSIETTTVPQDAVSRSQRRGRTGRGRLGIYRYVTPGERPSGIFDTSVLCECYDAGCAWYELTPAE
7. HCV5 consensus     DSVIDCNTAVTQTVDFSLDPTFTIETTTVPQDAVSRSQRRGRTGRGRHGIYRYVSSGERPSGIFDSVVLCECYDAGCAWYDLTPAE
8. HCV6 consensus     DSVIDCNVAVTQVVDFSLDPTFSIETTTVPQDAVSRSQRRGRTGRGKPGVYRYVSQGERPSGMFDTVVLCEAYDTGCAWYELTPSE
9. HCV7: ABN05226     DSVIDCNVAVTQTVDFSLDPTFTIETTTVPQDSVSRSQRRGRTGRGRLGIYRYVSSGERPSGMFDTSVLCECYDLGCSWYELTPSE
14. AVI1a-129          DSVIDCNTCVTQTVDFSLDPTFTIETTTLPQDAVSRTQRRGRTGRGKPGIYRFVAPGERPSGMFDSSVLCECYDAGCAWYELTPAE
15. AVI3a-177          DSVIDCNVTVEQYVDFSLDPTFSIETRTAPQDAVSRSQRRGRTGRGRLGTYRYVAPGERPSGMFDSVVLCECYDAGCSWYDLQPAE
```

FIG. 12F

```
                     1,550     1,560     1,570     1,580     1,590     1,600     1,610     1,620     1,630
Consensus            TTVRLRAYLNTPGLPVCQDHLEFWEGVFTGLTHIDAHFLSQTKQSGENFPYLVAYQATVCARAXAPPPSWDXMWKCLIRLKPTLHG
                     NS3

1. HCV1a consensus   TTVRLRAYMNTPGLPVCQDHLEFWEGVFTGLTHIDAHFLSQTKQSGENLPYLVAYQATVCARAQAPPPSWDQMWKCLIRLKPTLHG
2. HCV1b consensus   TSVRLRAYLNTPGLPVCQDHLEFWESVFTGLTHIDAHFLSQTKQAGDNFPYLVAYQATVCARAQAPPPSWDQMWKCLIRLKPTLHG
3. HCV2a Consensus   TTVRLRAYFNTPGLPVCQDHLEFWEAVFTGLTHIDAHFLSQTKQSGENFAYLVAYQATVCARAKAPPPSWDVMWKCLTRLKPTLVG
4. HCV2b Consensus   TTVRLRAYFNTPGLPVCQDHLEFWEAVFTGLTHIDAHFLSQTKQGGDNFAYLTAYQATVCARAKAPPPSWDVMWKCLTRLKPTLTG
5. HCV 3 Consensus   TTVRLRAYLSTPGLPVCQDHLDFWESVFTGLTHIDAHFLSQTKQQGLNFSYLTAYQATVCARAQAPPPSWDETWKCLVRLKPTLHG
6. HCV 4 Consensus   TTTRLRAYFNTPGLPVCQDHLEFWESVFTGLTQIDGHFLSQTKQSGENFPYLVAYQATVCARALAPPPSWDTMWKCLIRLKPTLHG
7. HCV5 consensus    TTVRLRAYLNTPGLPVCQDHLEFWEGVFTGLTNIDAHMLSQTKQGGENFPYLVAYQATVCVRAKAPPPSWDTMWKCMXRLKPTLTG
8. HCV6 consensus    TTVRLRAYLNTPGLPVCQDHLEFWEGVFTGLTHIDAHFLSQTKQGGENFAYLVAYQATVCARAKAPPPSWDTMWKCLIRLKPMLTG
9. HCV7: ABN05226    TTTRLRAYLNCPGLPVCQDHLEFWEGVFTGLTHIDAHFLSQTKQEGQNYAYLTAYQATVCARAKAPPPSWDVQWKCLQRLKPLLVG
14. AVI1a-129         TTVRLRAYMNTPGLPVCQDHLEFWEGVFTGLTHIDAHFLSQTKQSGENFPYLVAYQATVCARAQAPPPSWDQMWKCLIRLKPTLHG
15. AVI3a-177         TTVRLRAYLSTPGLPVCQDHLDFWESVFTGLTHIDAHFLSQTKQQGLNFSYLTAYQATVCARAQAPPPSWDEMWKCLLRLKPTLHG

                          1,640     1,650     1,660     1,670     1,680     1,690     1,700     1,710     1,720
Consensus            PTPLLYRLGAVQNEVTLTHPITKYIMTCMSADLEVVT---STWVLVGGVLAALAAYCLSTGCVVIVGRIVLSGKPAXIPDREVLYQ
                     NS3                                     NS4a

1. HCV1a consensus   PTPLLYRLGAVQNEVTLTHPITKYIMTCMSADLEVVT---STWVLVGGVLAALAAYCLSTGCVVIVGRIVLSGKPAIIPDREVLYR
2. HCV1b consensus   PTPLLYRLGAVQNEVTLTHPITKYIMACMSADLEVVT---STWVLVGGVLAALAAYCLTTGSVVIVGRIILSGKPAIIPDREVLYQ
3. HCV2a Consensus   PTPLLYRLGSVTNEVTLTHPVTKYIATCMQADLEVMT---STWVLAGGVLAAVAAYCLATGCVSIIGRLHINQRAVVAPDKEVLYE
4. HCV2b Consensus   PTPLLYRLGAVTNEVTLTHPVTKYIATCMQADLEIMT---STWVLAGGVLAAVAAYCLATGCISIIGRLHLNDQVVVAPDKEILYE
5. HCV 3 Consensus   PTPLLYRLGPVQNEICLTHPITKYIMACMSADLEVTTSTWSTWVLLGGVLAALAAYCLSVGCVVIVGHIELGGKPALVPDKEVLYQ
6. HCV 4 Consensus   PTPLLYRLGSVQNEVTLTHPITKYIMACMSADLEVVT---STWVLVGGVLAALAAYCLSVGSVVIVGRVVLSGQPAVIPDREVLYQ
7. HCV5 consensus    PTPLLYRLGAVQNEITLTHPITKYIMACMSADLEVIT---STWVLVGGVVAALAAYCLTVGSVAIVGRIILSGRPAIIPDREVLYQ
8. HCV6 consensus    PTPLLYRLGAVQNEITTTHPITKYIMTCMSADLEVIT---STWVLVGGVLAALAAYCLSVGCVVICGRITTTGKPAVIPDREVLYQ
9. HCV7: ABN05226    PTPLLYRLGSVTNEVTFTHPITKYIATCMAADLEVTT---STWVIVGGVLAAVAAYCMSTGSVVVVGRVVLGSNVVTAPDREVLYQ
14. AVI1a-129         PTPLLYRLGAVQNEVVLTHPITKYIMTCMSADLEVVT---STWVLVGGVLAALAAYCLSTGCVVIVGRVVLSGKPAIIPDREVLYQ
15. AVI3a-177         PTPLLYRLGPVQNETCLTHPVTKYIMACMSADLEVTT---STWVLLGGVLAALAAYCLSVGCVVIVGHIELGGKPALIPDKEVLYQ

                              1,730     1,740     1,750     1,760     1,770     1,780     1,790     1,800
Consensus            QFDEMEECSQHLPYIEQGQQIAEQFKQKALGLLQTATKQAEVIAPAVQXNWQKLEQFWAKHMWNFISGIQYLAGLSTLPGNPAVAS
                                                   NS4b
                     NS4a

1. HCV1a consensus   EFDEMEECSQHLPYIEQGMMLAEQFKQKALGLLQTASRQAEVIAPAVQTNWQKLEAFWAKHMWNFISGIQYLAGLSTLPGNPAIAS
2. HCV1b consensus   EFDEMEECASHLPYIEQGMQLAEQFKQKALGLLQTATKQAEAAAPVVESKWRALE-FWAKHMWNFISGIQYLAGLSTLPGNPAIAS
3. HCV2a Consensus   AFDEMEECASRAALIEEGQRIAEMLKSKIQGLLQQASKQAQDIQPAVQASWPKVEQFWAKHMWNFISGIQYLAGLSTLPGNPAVAS
4. HCV2b Consensus   AFDEMEECASKAALIEEGQRMAEMLKSKIQGLLQQATRQAQDIQPAIQSSWPKLEQFWAKHMWNFISGIQYLAGLSTLPGNPAVAS
5. HCV 3 Consensus   QYDEMEECSQAAPYIEQAQVIAHQFKEKVLGLLQRATQQQAVIEPIVATNWQKLEAFWHKHMWNFVSGIQYLAGLSTLPGNPAVAS
6. HCV 4 Consensus   QFDEMEECSKHLPLVEHGLQLAEQFKQKAVGLLNFAGKQAQEATPVIQSNFAKLEQFWAKHMWNFISGIQYLAGLSTLPGNPAIAS
7. HCV5 consensus    QFDEMEECSASLPYMDEARAIAEQFKEKVLGLIGTAGQKAETLKPAATSMWXKAEQFWAKHMWNFVSGIQYLAGLSTLPGNPAVAT
8. HCV6 consensus    QFDEMEECSRHIPYLAEGQQIAEQFKQKVLGLLQTTAKQAEELKPAVHSAWPKLEQFWQKHLWNFVSGIQYLAGLSTLPGNPAVAS
9. HCV7: ABN05226    HFDEMEECSKAPELLKHAQTIGGMFKDKALAVLDTLKPAAQAAVPIVETNFQKVEKLWNQHMWNFISGIQYLAGLSTLPGNPTVAS
14. AVI1a-129         EFDEMEECSQHLPYIEQGMMLAEQFKQKALGLLQTASRQAEVIAPAVQTNWQKLEAFWAKHMWNFISGIQYLAGLSTLPGTPAIAS
15. AVI3a-177         QYDEMEECSQAAPYVEQAQAIAHQFKEKLLGLLQRATQQQAVIEPIVATNWQKLEAFWHKHMWNFVSGIQYLAGLSTLPGNPAVAS
```

FIG. 12G

```
                      1,810     1,820     1,830     1,840     1,850     1,860     1,870     1,880     1,890
Consensus             LMAFTAAVTSPLTTSQTLLFNILGGWVASQLAPPTAATAFVVSGLAGAAVGSIGLGKVLVDILAGYGAGVAGALVAFKIMSGEXPS
                      NS4b

1. HCV1a consensus    LMAFTAAVTSPLTTSQTLLFNILGGWVAAQLAAPGAATAFVGAGLAGAAIGSVGLGKVLVDILAGYGAGVAGALVAFKIMSGEVPS
2. HCV1b consensus    LMAFTASITSPLTTQHTLLFNILGGWVAAQLAPPSAASAFVGAGIAGAAVGSIGLGKVLVDILAGYGAGVAGALVAFKVMSGEMPS
3. HCV2a Consensus    MMAFSAALTSPLSTSTTILLNILGGWLASQIAPPAGATGFVVSGLVGAAVGSIGLGKVLVDILAGYGAGISGALVAFKIMSGEKPS
4. HCV2b Consensus    MMAFSAALTSPLPTSTTILLNIMGGWLASQIAPPAGATGFVVSGLVGAAVGSIGLGKILVDVLAGYGAGISGALVAFKIMSGEKPS
5. HCV 3 Consensus    LMAFTASVTSPLTTNQTMFFNILGGWVATHLAGPQSSSAFVVSGLAGAAIGGIGLGRVLLDILAGYGAGVSGALVAFKIMGGELPT
6. HCV 4 Consensus    LMSFTAAVTSPLTTQQTLLFNILGGWVASQIATPTASTAFVVSGLAGAAVGSVGLGKILVDILAGYGAGVAGAVVTFKIMSGEMPS
7. HCV5 consensus     LMSFTAAVTSPLTTQQTLLFNILGGWVASQIAPPTAATAFVVSGMAGAAVGSIGLGRVLIDILAGYGAGVAGALVAFKIMCGERPT
8. HCV6 consensus     LMSFSASLTSPLSTSTTLLLNILGGWVASQLAPPTASTAFVVSGLAGAAVGSIGLGRVLVDILAGYGAGVSGALVAFKIMSGETPA
9. HCV7: ABN05226     LMAFTASVTSPLATSTTLLVNILGGWFASQLAPPSAATTFVVSGLAGAAVGSVGLGKVLVDVLAGYGAGIAGALVAFKIMSGEVPS
14. AVI1a-129          LMAFTAAVTSPLTTSQTLLFNILGGWVAAQLAAPGAATAFVGAGLAGAAIGSVGLGKVLVDILAGYGAGVAGALVAFKIMSGE?PS
15. AVI3a-177          LMAFTASVTSPLTTNQTMFFNILGGWVATHLAGPQSSSAFVVSGLAGAAIGGIGLGRVLLDILAGYGAGVSGALVAFKIMGGEIPT

                      1,900     1,910     1,920     1,930     1,940     1,950     1,960     1,970
Consensus             TEDLVNLLPAILSPGALVVGVVCAAILRRHVGPGEGAVQWMNRLIAFASRGNHVSPTHYVPESDAAARVTQILSSLTVTSLLRRLH
                      NS4b

1. HCV1a consensus    TEDLVNLLPAILSPGALVVGVVCAAILRRHVGPGEGAVQWMNRLIAFASRGNHVSPTHYVPESDAAARVTAILSSLTVTQLLRRLH
2. HCV1b consensus    TEDLVNLLPAILSPGALVVGVVCAAILRRHVGPGEGAVQWMNRLIAFASRGNHVSPTHYVPESDAAARVTQILSSLTITQLLKRLH
3. HCV2a Consensus    MEDVVNLLPGILSPGALVVGVICAAILRRHVGPGEGAVQWMNRLIAFASRGNHVAPTHYVTESDASQRVTQLLGSLTITSLLRRLH
4. HCV2b Consensus    VEDVVNLLPAILSPGALVVGVICAAILRRHVGQGEGAVQWMNRLIAFASRGNHVAPTHYVAESDASQRVTQVLSSLTITSLLRRLH
5. HCV 3 Consensus    AEDMVNLLPAILSPGALVVGVICAAILRRHVGPGEGAVQWMNRLIAFASRGNHVSPTHYVPESDAAARVTALLSSLTVTSLLRRLH
6. HCV 4 Consensus    TEDLVNLLPAILSPGALVVGVVCAAILRRHVGPGEGAVQWMNRLIAFASRGNHVSPTHYVPESDAAARVTQILSSLTVTSLLRRLH
7. HCV5 consensus     AEDLVNLLPSILCPGALVVGVICAAVLRRHIGPGEGAVQWMNRLIAFASRGNHVSPTHYVPETDASAKVTQLLSSLTVTSLLKRLH
8. HCV6 consensus     XEDMVNLLPALLSPGALVVGVVCAAILRRHVGPAEGATQWMNRLIAFASRGNHVSPTHYVPETDASRXVTTILSSLTITSLLRRLH
9. HCV7: ABN05226     TEDLANLLPAILSPGALVVGVVCAAIIKRHTGTSEGVTQWMNRLIAFASRGNHVSPTHYIQDDDASKRVMGILSSLTITSLIKRVL
14. AVI1a-129          TEDLVNLLPAILSPGALVVGVVCAAILRRHVGPGEGAVQWMNRLIAFASRGNHVSPTHYVPESDAAARVTAILSSLTVTQLLRRLH
15. AVI3a-177          AEDMVNLLPAILSPGALVVGVICAAILRRHVGPGEGAVQWMNRLIAFASRGNHVSPTHYVPESDAAARVTALLSSLTVTSLLRRLH

                      1,980     1,990     2,000     2,010     2,020     2,030     2,040     2,050     2,060
Consensus             QWINEDCSTPCSGSWLRDIWDWVCTVLSDFKTWLKAKLLPQLPGIPFLSCQRGYKGVWRGDGVMHTRCPCGAEITGHVKNGSMRIV
                      NS4b      NS5a

1. HCV1a consensus    QWISSECTTPCSGSWLRDIWDWICEVLSDFKTWLKAKLMPQLPGIPFVSCQRGYRGVWRGDGIMHTRCHCGAEITGHVKNGTMRIV
2. HCV1b consensus    QWINEDCSTPCSGSWLRDVWDWICTVLTDFKTWLQSKLLPRLPGVPFLSCQRGYKGVWRGDGIMQTTCPCGAQITGHVKNGSMRIV
3. HCV2a Consensus    NWITEDCPIPCAGSWLRDVWDWVCTILTDFKNWLTSKLFPKMPGLPFISCQKGYKGVWAGTGIMTTRCPCGANISGNVRLGSMRIT
4. HCV2b Consensus    AWITEDCPVPCSGSWLRDIWDWVCSILTDFKNWLSSKLLPKMPGLPFISCQKGYRGVWAGTGVMTTRCPCGANISGHVRMGTMKIT
5. HCV 3 Consensus    QWINEDYPSPCSGDWLRTIWDWVCTVLSDFKTWLSAKIMPALPGLPFISCQKGYKGVWRGDGVMSTRCPCGASITGHVKNGSMRLA
6. HCV 4 Consensus    KWINEDCSTPCAESWLWEVWDWVCTVLSDFKTWLKAKLLPLMPGIPFLSCQRGYKGEWRGDGVMHTTCPCGAELAGHIKNGSMRIT
7. HCV5 consensus     TWIGEDYSTPCDGTWLRAIWDWVCTALTDFKAWLQAKLLPQLPGVPFLSCQRGYKGVWRGDGVNSTKCPCGATISGHVKNGTMRIV
8. HCV6 consensus     EWINXDWSTPCATSWLRDIWDWVCTVLSDFKTWLKAKLVPSLPGIPFLSCQRGFRGVWRGDGVCHTTCTCGAVIAGHVKNGTMKIS
9. HCV7: ABN05226     AWAQTDYSAPCAGSWLREVWDWVCMVLSDFASWLKAKVLPSLPGIPFLSCQKGYKGEWRNDGIMNTKCPCGALIAGHVKNGSMRIV
14. AVI1a-129          QWISSECTTPCSGSWLRDIWDWICEVLSDFKTWLKAKLMPQLPGIPFVSCQRGYRGVWRGDGIMHTRCHCGAEITGHVKNGTMRIV
15. AVI3a-177          HWINEDYPSPCSGDWLRTIWDWVCMVLSDFRTWLSAKIMPALPGLPFLSCQKGYKGVWRGDGVVSTRCPCGASITGHVKNGSMRLA
```

FIG. 12H

```
                    2,070     2,080     2,090     2,100     2,110     2,120     2,130     2,140     2,150
Consensus           GPKTCSNTWHGTFPINAYTTGPXXPXPAPNYKRALWRVXAEEYVEVRRVGDFHYVTGXTTDNLKCPCQVPAPEFFTEVDGVRLHRX
                    NS5a

1. HCV1a consensus  GPRTCRNMWSGTFPINAYTTGPCTPLPAPNYTFALWRVSAEEYVEIRQVGDFHYVTGMTTDNLKCPCQVPSPEFFTELDGVRLHRF
2. HCV1b consensus  GPKTCSNTWHGTFPINAYTTGPCTPSPAPNYSRALWRVAAEEYVEVTRVGDFHYVTGMTTDNVKCPCQVPAPEFFTEVDGVRLHRY
3. HCV2a Consensus  GPKTCMNTWQGTFPINCYTEGQCVPKPAPNFKTAIWRVAASEYAEVTQHGSYSYITGLTTDNLKVPCQLPSPEFFSWVDGVQIHRF
4. HCV2b Consensus  GPKTCLNLWQGTFPINCYTEGPCVPKPPPNYKTAIWRVAASEYVEVTQHGSFSYVTGLTSDNLKVPCQVPAPEFFSWVDGVQIHRF
5. HCV 3 Consensus  GPRTCANMWHGTFPINEYTTGPSTPCPSPNYTRALWRVAANSYVEVRRVGDFHYITGATEDELKCPCQVPAAEFFTEVDGVRLHRY
6. HCV 4 Consensus  GPKTCSNTWHGTFPINAYTTGPGVPIPAPNYKFALWRVSAEEYVEVRRVGDFHYVTGVTQDNIKCPCQVPAPEFFTEVDGIRLHRH
7. HCV5 consensus   GPKLCSNTWHGTFPINATTTGPSVPAPAPNYKFALWRVGAADYAEVRRVGDYHYITGVTQDNLKCPCQVPSPEFFTELDGVRIHRY
8. HCV6 consensus   GPRTCSNTWHGTFPINATTTGPSVPIPEPNYKRALWRVSAEDYVEVVRVGDCHYVVGATADNLKCPCQVPAPEFFTEVDGVRLHRY
9. HCV7: ABN05226  GPKTCRNTWWGTFPINSHTTGPSSPVPSHCYQRALWRVSATEYVEILRHNDQHYVVGVTAEDLKCPCQVPSPEFFSFVDGVRIHRF
14. AVI1a-129      GPRTCRNMWSGTFPINAYTTGPCTPLPAPNYKFALWRVSAEEYVEIRQVGDFHYVTGMTTDDLKCPCQVPSPEFFTELDGVRLHRF
15. AVI3a-177      GPRTCANMWHGTFPINEYTTGPSTPCPSPNYTRALWRVAANSYVEVRQVGDFHYITGATEDGLKCPCQVPAAEFFTEVDGVRLHRY
                         2,160     2,170     2,180     2,190     2,200     2,210     2,220     2,230
Consensus           APPCKPLLRDEVTFSVGLNSYVVGSQLPCEPEPDVAVLTSMLTDPSHITAETAARRLARGSPPSLASSSASQLSAPSLKATCTTHH
                    NS5a

1. HCV1a consensus  APPCKPLLREEVSFRVGLHEYPVGSQLPCEPEPDVAVLTSMLTDPSHITAEAAGRRLARGSPPSVASSSASQLSAPSLKATCTANH
2. HCV1b consensus  APACKPLLREEVTFQVGLNQYLVGSQLPCEPEPDVAVLTSMLTDPSHITAETAKRRLARGSPPSLASSSASQLSAPSLKATCTTRH
3. HCV2a Consensus  APTPKPFFRDEVSFCVGLNSFVVGSQLPCDPEPDTDVLMSMLTDPSHITAEAAARRLARGSPPSEASSSASQLSAPSLRATCTTHG
4. HCV2b Consensus  APTPGPFFRDEVTFTVGLNSFVVGSQLPCDPEPDTEVLASMLTDPSHITAEAAARRLARGSPPSQASSSASQLSAPSLKATCTTHK
5. HCV 3 Consensus  APPCKPLLRDEITFMVGLNSYAIGSQLPCEPEPDVSVLTSMLRDPSHITAETAARRLARGSPPSEASSSASQLSAPSLKATCQTHR
6. HCV 4 Consensus  APKCKPLLRDEVSFSVGLNSFVVGSQLPCEPEPDVAVLTSMLTDPSHITAETASRRLARGSPPSLASSSASQLSAPSLKATCTARH
7. HCV5 consensus   APPCNPLLREEVCFSVGLHSYVVGSQLPCEPEPDVTVLTSMLSDPAHITAETAKRRLDRGSPPSLASSSASQLSAPSLKATCTTQG
8. HCV6 consensus   APPCKPLLRDEVTFSVGLSSYAIGSQLPCEPEPDVTVVTSMLTDPSHITAETAARRLARGSPPSLASSSASQLSAPSLKATCTTHG
9. HCV7: ABN05226  APEPKPMIREEAAFVVGLHSYVVGSQLPCEPEPDVQTVSQLLTDPSHITAETAARRLRRGSPPSNASSSASQLSAPSLKATHTTLP
14. AVI1a-129      APPCKPLLREEVSFRVGLHAYPVGSQLPCEPEPDVAVLTSMLTDPSHITAETA?RRLARGSPPSVASSSASQLSAPSLKATCTANH
15. AVI3a-177      APPCKPLLRDEITFMVGLNSYAIGSQLPCEPEPDVSVLTSMLRDPSHITAETAARRLARGSPPSEASSSASQLSAPSLKATCQTHR
                    2,240     2,250     2,260     2,270     2,280     2,290     2,300     2,310     2,320
Consensus           DHPDAELIEANLLWRQEMGGNITRVESENKVVILDSFDPLVAE-EDDREISVPAECLRKXR-KFPPALPIWARPDYNPPLLETWKR
                    NS5a

1. HCV1a consensus  DSPDAELIEANLLWRQEMGGNITRVESENKVVILDSFDPLVAE-EDEREISVPAEILRKSR-RFAPALPIWARPDYNPPLLETWKK
2. HCV1b consensus  DSPDADLIEANLLWRQEMGGNITRVESENKVVILDSFDPLRAE-EDEREVSVPAEILRKSR-KFPPAMPIWARPDYNPPLLESWKD
3. HCV2a Consensus  KTYDVDMVDANLF----MGGDVTRIESESKVVVLDSLDPM-AEERSDLEPSIPSEYMLPRN-RFPPALPAWARPDYNPPLVESWKR
4. HCV2b Consensus  MAYDCDMVDANLF----MGGDVTRIESDSKVIVLDSLDSM-TEVEDDREPSVPSEYLIRRR-KFPPALPPWARPDYNPPVIETWKR
5. HCV 3 Consensus  PHPDAELVDANLLWRQEMGSNITRVESETKVVILDSFEPLRAE-TDDAELSVAAECFKKPP-KYPPALPIWARPDYNPPLLDRWKA
6. HCV 4 Consensus  DSPGTDLLEANLLW----GSTATRVETDEKVIILDSFEPCVAEPDDDREVSVAAEILRPTK-KFPPALPIWARPDYNPPLTETWKQ
7. HCV5 consensus   HHPDADLIEANLLWRQCMGGNITRVEAENKVVILDSFEPLKXE-EDDREISVSADCFRRGP-AFPPALPIWARPGYDPPLLETWKR
8. HCV6 consensus   DHPDAELIEANLLWRQEMGGNITRVESENKVIVLDSFDPLVAE-YDDREISVSAECHRPPRPKFPPALPIWARPDYNPPLLETWKA
9. HCV7: ABN05226  QHPDAELIEANLMWEHKVGA-IRRMETDTKVIILDSFDSA-SSVEDDMEPSTAAECLRTRK-VFPPAMPIWARPDYNPPVVENWKD
14. AVI1a-129      DSPDAELIEANLLWRQEMGGNITRVESENKVVILDSFDPLVAE-EDEREISVPAEILRKSR-RFTQALPVWARPDYNPPLVEAWKK
15. AVI3a-177      PHPDAELVDANLLWRQEMGSNITRVESETKVVILDSFEPLRAE-ADDAELSVAAECFKKPP-KYPPALPIWARPDYNPPLLDRWKT
```

FIG. 12I

```
                   2,330     2,340     2,350     2,360     2,370     2,380     2,390     2,400
Consensus          PDYEPPTVHGCALPPPXAPPVPPPRRK-RTVXLTESTVSTALAELAEKSFGSSEXSGXX-SXSGXDTTSSXXSXPP-DCDAXSDAE
                                                      NS5a

1. HCV1a consensus PDYEPPVVHGCPLPPPQSPPVPPPRKK-RTVVLTESTVSTALAELATKSFGSSSTSGI----TGDNTTTSSEPAPS-GCPPDSDAE
2. HCV1b consensus PDYVPPVVHGCPLPPTKAPPIPPPRRK-RTVVLTESTVSSALAELATKTFGSSESSA-----VDSGTATAPPDQPSDDGDAGSDVE
3. HCV2a Consensus PDYQPPTVAGCALPPPKKTPTPPPRRR-RTVGLSESTIGDALQQLAIKTFGQPPPSGDSGLSTGADAADSGGRTPP-DELALSETG
4. HCV2b Consensus PGYEPPTVLGCALPPTPQAPVPPPRRR-RAKVLTQDNVEGVLREMADKVLSPLQDHNDSGHSTGADTGGDSVQQPS-DETAASEAG
5. HCV 3 Consensus PDYVPPTVHGCALPPRGAPPVPPPRRK-RTIQLDGSNVSAALAALAEKSFPSSKPQEENSSSSGVDTQSSTTSKVPPSPGGESDSE
6. HCV 4 Consensus QDYKPPTVHGCALPPSKQPPVPPPRRK-RTVQLTESVVSTALAELAAKTFGQSELGSDSGADLTTGPTETTDSGPILVDDA-SDDG
7. HCV5 consensus  PDYDPPQVSGCPLPPAGLPPVPPPRRKRKPVELSDSTVSQVLADLADARF-KXDTPSIEGQDSAVGTSSQXDSGPEEKRDDXSDAA
8. HCV6 consensus  PDYEPPVVSGCALPPPGPPPIPPPRRK-KVVHLDESTVSHALAQLAEKSFPESSSDSTS-SDSGLSITSSGSPEPTTDDDACSEAG
9. HCV7: ABN05226  PEYAPPQVSGCALPPAQTPPVPPPRRKRAVIQLTESAVSTALAELAERSFPKEEAPP---SDSAISLDSPAANDPPSDCDQGSEI-
14. AVI1a-129      PDYEPPVVHGCPLPPPKSPPVPPPRKK-RTVVLTESTLSTALAELATKSFGSSSTSGI----TGDNTTTSSEPAPP-GCSPDSDAE
15. AVI3a-177      PDYVPPTVHGCALPPRGAPPVPPPRRK-RTVQLDGSNVSAALAALAEKSFPSLEPQGENSSSSGIDIQSSTASEVPPSPEGESDSE

                   2,410     2,420     2,430     2,440     2,450     2,460     2,470     2,480     2,490
Consensus          SYSSMPPLEGEPGDPDLSD--------------------GSWSTVSDEE--DSVVCCSMSYSWTGALITPCAAEEEKLPINPLSNS
                                      NS5a                                      NS5b

1. HCV1a consensus SYSSMPPLEGEPGDPDLSD--------------------GSWSTVSSEADTEDVVCCSMSYSWTGALVTPCAAEEQKLPINALSNS
2. HCV1b consensus SYSSMPPLEGEPGDPDLSD--------------------GSWSTVSEEAS-EDVVCCSMSYTWTGALITPCAAEESKLPINALSNS
3. HCV2a Consensus SISSMPPLEGEPGDPDLEPEQVELQPPPQGGEVAPGSDSGSWSTCSEED--DSVVCCSMSYSWTGALITPCSPEEEKLPINPLSNS
4. HCV2b Consensus SLSSMPPLEGEPGDPDLEFEPAGSAPPSEGECEVIDSDSKSWSTVSDQE--DSVICCSMSYSWTGALITPCGPEEEKLPINPLSNS
5. HCV 3 Consensus SCSSMPPLEGEPGDPDLSCDQVELQPPPQGGGVAPGSGSGSWSTVSDSEE-QSVVCCSMSYSWTGALITPCSAEEEKLPISPLSNS
6. HCV 4 Consensus SYSSMPPLEGEPGDPDLTSDQVELQPPPQGGGVAPGSGSGSWSTVSGSE--DTVVCCSMSYSWTGALVTPCAAEESKLPISPLSNS
7. HCV5 consensus  SYSSMPPLEGEPGDPDLSS--------------------GSWSTVSDE---DSVVCCSMSYSWTGALITPCSAEEEKLPINPLSNT
8. HCV6 consensus  SYSSMPPLEGEPGDPDLSS--------------------GSWSTVSEE---DSVVCCSMSYSWTGALITPCAAEEEKLPINPLSNS
9. HCV7: ABN05226  SFSSMPPLEGEPGDPDLSD--------------------GSWSTVSTR---SDVICCSMSYSWTGALVTPSGPEEERLPINALSNT
14. AVI1a-129      SCSSMPPLEGEPGDPDLSD--------------------GSWSTVSSEADTEDVVCCSMSYTWTGALITPCAAEEQKLPINALSNS
15. AVI3a-177      SCTSMPPLEGEPGDPDLSC--------------------DSWSTVSDSEE-QSVVCCSMSYSWTGALITPCSAEEEKLPISPLSNS

                   2,500     2,510     2,520     2,530     2,540     2,550     2,560     2,570     2,580
Consensus          LLRHHNLVYSTTSRSASQRQKKVTFDRLQVLDDHYXDVLKEVKAXASKVKARLLSVEEACALTPPHSARSKFGYGAKDVRSLSRKA
                                                      NS5b

1. HCV1a consensus LLRHHNLVYSTTSRSACQRQKKVTFDRLQVLDSHYQDVLKEVKAAASKVKANLLSVEEACSLTPPHSAKSKFGYGAKDVRCHARKA
2. HCV1b consensus LLRHHNMVYATTSRSASQRQKKVTFDRLQVLDDHYRDVLKEMKAKASTVKAKLLSVEEACKLTPPHSARSKFGYGAKDVRNLSSKA
3. HCV2a Consensus LLRYHNKVYCTTSKSASLRAKKVTFDRMQVLDAHYDSVLKDIKLAASKVSARLLTLEEACQLTPPHSARSKYGFGAKEVRSLSGRA
4. HCV2b Consensus LMRFHNKVYSTTSRSASLRAKKVTFDRVQVLDAHYDSVLQDVKRAASKVSARLLSVEEACALTPPHSAKSRYGFGAKEVRSLSRRA
5. HCV 3 Consensus LLRHHNLVYSTSSRSASQRQKKVTFDRLQVLDDHYKTALKEVKERASRVKARMLTIEEACALVPPHSARSKFGYSAKDVRSLSSKA
6. HCV 4 Consensus LLRHHNMVYATTTRSAVTRQKKVTFDRLQVVDNHYNETLKEIKARASRVKARLLTTEEACDLTPPHSAKSKFGYGAKDVRSHSRKA
7. HCV5 consensus  LLRHHNLVYSTSSRSAGLRQKKVTFDRLQVLDDHYREVVDEMKRLASKVKARLLPLEEACGLTPPHSARSKYGYGAKEVRSLDKKA
8. HCV6 consensus  LIRHHNLVYSTTSRSASLRQKKVTFDRVQVLDQHYQDVLKEIKLRASQVQARLLSTEEACDLTPPHSARSKFGYGAKDVRSHASKA
9. HCV7: ABN05226  MLRHYNMVYSTTSRSASQRAKKVTFDRLQVLDDHYKRALADVKADASTVKAQLLSVEEAAALTPAHSARSKFGYGAKEVRSLAPKA
14. AVI1a-129      LLRHHNLVYSTTSRSACQRQKKVTFDRLQVLDNHYQDVLKEVKAAASKVKANLLSVEEACSLTPPHSAKSKFGYGAKDVRCHARKA
15. AVI3a-177      LLRHHNLVYSTSSRSASQRQKKVTFDRLQVLDDHYKAVLKEVKERASRVKARMLTIEEACALVPPHSARSKFGYSAKDVRSLSGRA
```

FIG. 12J

```
                   2,590     2,600     2,610     2,620     2,630     2,640     2,650     2,660
Consensus          VNHIXSVWXDLLEDSTTPIPTTIMAKNEVFCVDPXKGGRKPARLIVYPDL-GVRVCEKRALYDVXQKLPKAVMGSSYGFQYSPAQR
                   NS5b

1. HCV1a consensus VNHINSVWKDLLEDSVTPIDTTIMAKNEVFCVQPEKGGRKPARLIVFPDL-GVRVCEKMALYDVVSKLPLAVMGSSYGFQYSPGQR
2. HCV1b consensus VNHIRSVWKDLLEDTETPIDTTIMAKNEVFCVQPEKGGRKPARLIVFPDL-GVRVCEKMALYDVVSTLPQAVMGSSYGFQYSPGQR
3. HCV2a Consensus VNHIKSVWKDLLEDSQTPIPTTIMAKNEVFCVDPTKGGKKAARLIVYPDL-GVRVCEKMALYDVTQKLPQAVMGASYGFQYSPAQR
4. HCV2b Consensus VNHIRSVWEDLLEDQHTPIDTTIMAKNEVFCVDPTKGGKKPARLIVYPDL-GVRVCEKMALYDIAQKLPKAIMGPSYGFQYSPAER
5. HCV 3 Consensus INQIRSVWEDLLEDTTTPIPTTIMAKNEVFCVDPAKGGRKPARLIVYPDL-GVRVCEKRALYDVIQKLSIETMGSAYGFQYSPQQR
6. HCV 4 Consensus INHINSVWEDLLEDNNTPIPTTIMAKNEVFAVNPAKGGRKPARLIVYPDLGGVRVCEKRALHDVINQLPKAVMGAAYGFQYSPAQR
7. HCV5 consensus  LXHIEGVWQDLLDDSDTPLPTTIMAKNEVFAVEPSKGGKKPARLIVYPDL-GVRVCEKRALYDXAQKLPTALMGPSYGFQYSPAQR
8. HCV6 consensus  INHINSVWEDLLEDNQTPIPTTIMAKNEVFCVDPSKGGRKPARLIVYPDL-GVRVCEKRALYDITRKLPVAVMGDAYGFQYSPKQR
9. HCV7: ABN05226 MSHIKEVWKDLLQDMTTPIPTTIMAKNEVFCVNPAKGGKKPARLIVYPDL-GVRVCEKRALYDIAQKLPKAIMGQAYGFQYSPSQR
14. AVI1a-129      VNHINSVWKDLLEDSVTPIDTTIMAKNEVFCVQPEKGGRKPARLIVFPDL-GVRVCEKMALYDVVSKLPLAVMGDSYGFQYSPGQR
15. AVI3a-177      VNQIRSVWEDLLEDTTTPIPTTIMAKNEVFCVDPSKGGRKPARLIVYPDL-GVRVCEKRALYDVIQKLSIATMGSAYGFQYSPQQR

                   2,670     2,680     2,690     2,700     2,710     2,720     2,730     2,740     2,750
Consensus          VEFLLKAWKSKKTPMG--FSYDTRCFDSTVT-EXDIRTEEXIYQCCDLDPEARKAIXSLTERLYVGGPMXNSKGQXCGYRRCRASG
                   NS5b

1. HCV1a consensus VEFLVQAWKSKKTPMG--FSYDTRCFDSTVT-ESDIRTEEAIYQCCDLDPQARVAIKSLTERLYVGGPLTNSRGENCGYRRCRASG
2. HCV1b consensus VEFLVNAWKSKKCPMG--FAYDTRCFDSTVT-ESDIRVEESIYQCCDLAPEARQAIRSLTERLYIGGPLTNSKGQNCGYRRCRASG
3. HCV2a Consensus VEFLLKAWAEKKDPMG--FSYDTRCFDSTVT-ERDIRTEESIYQACSLPEEARTAIHSLTERLYVGGPMFNSKGQTCGYRRCRASG
4. HCV2b Consensus VDFLLKAWGSKKDPMG--FSYDTRCFDSTVT-ERDIRTEESIYQACSLPQEARTVIHSLTERLYVGGPMTNSKGQSCGYRRCRASG
5. HCV 3 Consensus VERLLKMWTSKKTPLGVLFSYDTRCFDSTVTGEQDIRVEEEIYQCCNLEPEARKVISSLTERLYCGGPMFNSKGAQCGYRRCRASG
6. HCV 4 Consensus VEFLLTSWKSKKTPMG--FSYDTRCFDSTVT-EKDIRTEEEVYQCCDLEPEARKVITALTERLYVGGPMHNSKGDLCGYRRCRASG
7. HCV5 consensus  VEFLLKTWKSKKXPMA--FSYDTRCFDSTVT-EHDIMTEESIYQSCDLQPEARXAIRSLTQRLYCGGPMYNSKGQQCGYRRCRASG
8. HCV6 consensus  VDYLLKMWRSKKTPMG--FSYDTRCFDSTVT-ERDIRTEHDIYQSCQLDPEARKAITSLTERLYVGGPMYNSKGQSCGYRRCRASG
9. HCV7: ABN05226 VEYLVKTWKSKRTPMG--FSYDTRCFDSTVT-EQDIRTESEIYQCCNLDPEARTIINALTERLYVGGPMFNSKGQRVGYRRCRASG
14. AVI1a-129      VEFLVQAWKSKKTPMG--FSYDTRCFDSTVT-ESDIRTEEAIYQCCDLDPQARVAIKSLTERLYVGGPLTNSRGENCGYRRCRASG
15. AVI3a-177      VERLLEMWTSKKTPMG--FSYDTRCFDSTVT-EQDIRVEEEIYQCCNLEPEARKVISSLTERLYCGGPMFNSKGAQCGYRRCRASG

                   2,760     2,770     2,780     2,790     2,800     2,810     2,820     2,830
Consensus          VLTTSMGNTLTCYIKAXAACRAAGLRDCTMLVCGDDLVVICESAGVZEDAAXLRAFTEAMTR-----YSAPPGDPP-----QPEYD
                   NS5b

1. HCV1a consensus VLTTSCGNTLTCYIKARAACRAAGLQDCTMLVCGDDLVVICESAGVQEDAASLRAFTEAMTR-----YSAPPGDPP-----QPEYD
2. HCV1b consensus VLTTSCGNTLTCYLKASAACRAAKLQDCTMLVCGDDLVVICESAGTQEDAASLRVFTEAMTR-----YSAPPGDPP-----QPEYD
3. HCV2a Consensus VLTTSMGNTITCYVKALAACKAAGIVAPTMLVCGDDLVVISESQGTEEDERNLRAFTEAMTR-----YSAPPGDPP-----RPEYD
4. HCV2b Consensus VFTTSMGNTMTCYIKALAACKAAGIVDPIMLVCGDDLVVISESQGNEEDERNLRAFTEAMTR-----YSAPPGDLP-----RPEYD
5. HCV 3 Consensus VLPTSFGNTITCYIKATAAARAAGLRNPDFLVCGDDLVVVAESDGVDEDRAALRAFTEAMTRLWTRYYSAPPGDAPHRPTLQPTYD
6. HCV 4 Consensus VYTTSFGNTLTCYLKATAAIKAAGLRDCTMLVCGDDLVVIAESDGVEEDNRALRAFTEAMTR-----YSAPPGDAP-----QPAYD
7. HCV5 consensus  VFTTSMGNTMTCYIKALASCRAAKLRDCTLLVCGDDLVAICESQGTHEDEASLRAFTEAMTR-----YSAPPGDPP-----VPAYD
8. HCV6 consensus  VLPTSLGNTLTCYLKAQAACRAAGLKDFDMLVCGDDLVVISESAGVQEDAAALRAFTEAMTR-----YSAPPGDEP-----QPTYD
9. HCV7: ABN05226 VFPTSMGNTMTCYIKAKAAAAAAGLESTDFLVCGDDLVVICESKGVERDRADLQAFAAAMTR-----YSAPPGDMP-----QPAYD
14. AVI1a-129      VLTTSCGNTLTCYIKAKAACRAAGLQNCTMLVCGDDLVVICESAGVQEDAASLRAFTEAMTR-----YSAPPGDPP-----QPEYD
15. AVI3a-177      VLPTSFGNTITCYIKATAAARAAGLRNPDFLVCGDDLVLVAESDGVDEDRAALRAFTEAMTR-----YSAPPGDAP-----QPTYD
```

FIG. 12K

```
                    2,840     2,850     2,860     2,870     2,880     2,890     2,900     2,910     2,920
Consensus           LELITSCSSNVSVAHDXSGKRVYYLTRDPTTPLARAAWETARHTP---VNSWLGNIIMYAPTIWVRMVLMTHFFSILQXQEQLEXA
                    NS5b

1. HCV1a consensus  LELITSCSSNVSVAHDGAGKRVYYLTRDPTTPLARAAWETARHTP---VNSWLGNIIMFAPTLWARMILMTHFFSVLIARDQLEQA
2. HCV1b consensus  LELITSCSSNVSVAHDASGKRVYYLTRDPTTPLARAAWETARHTP---VNSWLGNIIMYAPTLWARMILMTHFFSILLAQEQLEKA
3. HCV2a Consensus  LELITSCSSNVSVALGPQGRRRYYLTRDPTTPIARAAWETVRHSP---VNSWLGNIIQYAPTIWVRMVLMTHFFSILMAQDTLDQN
4. HCV2b Consensus  LELITSCSSNVSVALDSRGRRRYFLTRDPTTPITRAAWETVRHSP---VNSWLGNIIQYAPTIWVRMVIMTHFFSILLAQDTLNQN
5. HCV 3 Consensus  LELITSCSSNVSVARDNKGKRYYYLTRDATTPLARAAWETARHTPGWGVNSWLGNIIMYAPTIWVRMVMMTHFFSILQSQEILDRP
6. HCV 4 Consensus  LELITSCSSNVSVAHDATGKKVYYLTRDPETPLARAAWETVRHTP---VNSWLGNIIVYAPTIWVRMVLMTHFFSILQSQEALEKA
7. HCV5 consensus   LELVTSCSSNVSVARDASGNRVYYLTRDPQVPLARAAWETAKHSP---VNSWLGNIIMYAPTLWARIVLMTHFFSVLQSQEQLEKA
8. HCV6 consensus   LELITSCSSNVSVAHDGTGQRYYYLTRDPTTPLARAAWETARHTP---VNSWLGNIIMYAPTIWVRMVLMTHFFQILQSQEQLHKA
9. HCV7: ABN05226  LEHIDSCSSNVSVARDNSGKRVYYLTRDPTNPLSRAAWETARHSP---VNSWVGNIIMFAPTIWVRMVLMTHFFALLLNEERLNDP
14. AVI1a-129       LELITSCSSNVSVAHDGAGKRVYYLTRDPTTPLARAAWETARHTP---VNSWLGNIIMFAPTLWARMVLMTHFFSVLIARDQLEQA
15. AVI3a-177       LELITSCSSNVSVARDNKGKRYYYLTRDATTPLARAAWETARHTP---VNSWLGNIIMYAPTIWVRMVMMTHFFSILQSQEILDRP

                    2,930     2,940     2,950     2,960     2,970     2,980     2,990     3,000     3,010
Consensus           LDFEMYGATYSVTPLDLPAIIQRLHGLSAFSLHSYSPGELNRVAACLRKLGVPPLRAWRHRARAVRAKLIAQGGRAAICGKYLFNW
                    NS5b

1. HCV1a consensus  LDCEIYGACYSIEPLDLPPIIQRLHGLSAFSLHSYSPGEINRVAACLRKLGVPPLRAWRHRARSVRARLLSRGGRAAICGKYLFNW
2. HCV1b consensus  LDCQIYGACYSIEPLDLPQIIQRLHGLSAFSLHSYSPGEINRVASCLRKLGVPPLRVWRHRARSVRAKLLSQGGRAATCGKYLFNW
3. HCV2a Consensus  LNFEMYGSVYSVSPLDLPAIIERLHGLDAFSLHTYTPHELTRVASALRKLGAPPLRAWKSRARAVRASLISRGGRAAVCGRYLFNW
4. HCV2b Consensus  LNFEMYGAVYSVNPLDLPAIIERLHGLDAFSLHTYSPHELSRVAATLRKLGAPPLRAWKSRARAVRASLIAQGGRAAICGRYLFNW
5. HCV 3 Consensus  LDFEMYGATYSVTPLDLPAIIERLHGLSAFTLHSYSPVELNRVAGTLRKLGCPPLRAWRHRARAVRAKLIAQGGKAKICGLYLFNW
6. HCV 4 Consensus  LDFDMYGVTYSITPLDLPAIIQRLHGLSAFTLHGYSPHELNRVAGSLRKLGVPPLRAWRHRARAVRAKLIAQGGKAKICGIYLFNW
7. HCV5 consensus   LAFEMYGSVYSVTPLDLPAIIQRLHGLSAFSLHSYSPSEINRVASCLRKLGVPPLRAWRHRARAVRAKLIAQGGKAAICGIYLFNW
8. HCV6 consensus   LDFDIYGVTYSITPLDLPAIIQRLHGMAAFSLHGYSPGELNRVAACLRKLGAPPLRAWRHRARAVRAKLIAQGGKAAICGKYLFNW
9. HCV7: ABN05226  VSFEMYGATYTVCPTDLPDIIQRLHGLRAFELHTYSPAELTRVAATLRKLGVPPLRTWRQRARKVRAGLIGQGGRARICGLYLFNW
14. AVI1a-129       LDCEIYGACYSIEPLDLPPIIQRLHGLSAFSLHSYSPGEINRVAACLRKLGVPPLRTWRHRARSVRAKLLSRGGRAAICGKYLFNW
15. AVI3a-177       LDFEMYGATYSVTPLDLPAIIERLHGLSAFTLHSYSPVELNRVAGTLRKLGCPPLRAWRHRARAVRAKLIAQGGKAKICGLYLFNW

                    3,020     3,030     3,040     3,050     3,060     3,074
Consensus           AVRTKLKLTPLPAAGXLDLSSWFTVGAGGGDIYHSVSRARPRWLLLCLLLLXVGVGIFLLPARX
                    NS5b

1. HCV1a consensus  AVRTKLKLTPIAAAGQLDLSGWFTAGYSGGDIYHSVSHARPRWFWFCLLLLAAGVGIYLLPNRX
2. HCV1b consensus  AVRTKLKLTPIPAASQLDLSGWFVAGYSGGDIYHSLSRARPRWFMWCLLLLSVGVGIYLLPNRX
3. HCV2a Consensus  AVKTKLKLTPLPEARLLDLSSWFTVGAGGGDIYHSVSRARPRLLLLSLLLLXVGVGLFLLPAR
4. HCV2b Consensus  AVKTKLKLTPLPEASRLDLSGWFTVGAGGGDIFHSVSHARPRLLLLCLLLLSVGVGIFLLPAR
5. HCV 3 Consensus  AVRTKTKLTPLPAAGQLDLSSWFTVGVGGNDIYHSVSRARTRXLLLCLLLLTVGVGIFLLPAR
6. HCV 4 Consensus  AVKTKLKLTPLPAAANLDLSSWFTVGAGGGDIYHSVSRARPRYLLLCLLLLSVGVGIFLLPAR
7. HCV5 consensus   AVKTKRKLTPLADADRLDLSSWFTVGAGGGDIYHSMSRARPRXJLLCLLLLXVGVGIFLLPAR
8. HCV6 consensus   AVKTKLKLTPLRGASKLDLSGWFVAGYSGGDIYHSVSRARPRMLLLCLLLLTVGVGIFLLPAR
9. HCV7: ABN05226  AVRTKIKLTPLAGAGRLDLSSWFSVCAGEADVDHSTPRAHPRPLLLCLLLLAVGVGIFLLPAR
14. AVI1a-129       AVRTKLKLTPIAAAGRLDLSGWFTAGYSGGDIYHSVSHARPRWFWFCLLLLAAGVGIYLLPNR
15. AVI3a-177       AVRTKTNLTPLPAAGQLDLSSWFTVGVGGNDIYHSVSRARTRHLLLCLLLLTVGVGIFLLPAR
```

FIG. 12L

HEPATITIS C VIRUS IMMUNOGENIC COMPOSITIONS AND METHODS OF USE THEREOF

CROSS-REFERENCE

This application is a national stage filing under 35 U.S.C. § 371 of PCT/IB2017/055714, filed Sep. 21, 2017, which claims the benefit of U.S. Provisional Patent Application No. 62/397,763, filed Sep. 21, 2016, which applications are incorporated herein by reference in their entirety.

INCORPORATION BY REFERENCE OF SEQUENCE LISTING PROVIDED AS A TEXT FILE

A Sequence Listing is provided herewith as a text file, "UALB-034WO_SEQ LISTING_ST25.txt" created on Sep. 18, 2017 and having a size of 762 KB. The contents of the text file are incorporated by reference herein in their entirety.

INTRODUCTION

Hepatitis C virus (HCV) is a blood-borne pathogen that is estimated to infect 150-200 million people worldwide. Infection by HCV may be non-symptomatic, and can be cleared by patients, sometimes without medical intervention. However, the majority of patients develop a chronic HCV infection, which may lead to liver inflammation, scarring, and even to liver failure or liver cancer. In the United States alone, over 3 million people have a chronic infection.

The HCV virion contains a positive-sense single stranded RNA genome of about 9.5 kb. The genome encodes a single polyprotein of 3,010 to 3,030 amino acids. The structural proteins comprise a core protein forming the viral nucleocapsid and two envelope glycoproteins, E1 and E2.

A vaccine based on the recombinant envelope glycoproteins from a single genotype 1a strain (HCV-1) protected chimpanzees from chronic infection following homologous and heterologous genotype 1a (gt1a) viral challenge (reviewed in Houghton, M Immunol Rev 2011). Antisera from the immunized chimpanzees were shown to exhibit in vitro cross-neutralizing activity (Meunier et al. (2011) *J. Infect. Dis.* 204:1186). A phase I clinical trial was conducted in human volunteers with a similar antigen (Frey et al. (2010) *Vaccine* 28:6367). Antisera from selected vaccinated individuals were similarly capable of neutralizing chimeric cell culture-derived viruses (HCVcc) expressing the structural proteins of strains representing all 7 major HCV genotypes in vitro (Law et al. (2013) *PLoS One* 8:e59776) and to be able to compete with the binding of numerous discrete monoclonal antibodies with broad cross-neutralizing activities (Wong et al. (2014) *J. Virol.* 88:14278).

There is a need in the art for compositions and methods for inducing immune responses to HCV.

SUMMARY

The present disclosure provides an immunogenic composition comprising: a) i) a hepatitis C virus (HCV) heterodimeric polypeptide that includes HCV E1 and E2 polypeptides; ii) an HCV E1 polypeptide; or iii) an HCV E2 polypeptide; b) a heterologous polypeptide (also referred to herein as a "T-cell epitope polypeptide" or an "HCV T-cell epitope polypeptide") comprising T-cell epitopes (e.g., $CD4^+$ and $CD8^+$ T-cell epitopes that are conserved among heterogeneous HCV genotypes and that are presented through multiple HLA alleles common within the human population) present in an HCV protein other than E1 and E2; and c) a pharmaceutically acceptable excipient. The present disclosure provides a method of inducing an immune response, in an individual, to an HCV polypeptide. The present disclosure provides an immunogenic composition comprising: a) a polypeptide that comprises one or more T-cell epitopes (e.g., $CD4^+$ and $CD8^+$ T-cell epitopes that are conserved among heterogeneous HCV genotypes and that are presented through multiple HLA alleles common within the human population) present in an HCV protein other than E1 and E2; and b) a pharmaceutically acceptable excipient.

BRIEF DESCRIPTION OF THE DRAWINGS

FIG. 1A-1C provide an amino acid sequence alignment of examples of the core-E1-E2 coding regions of a HCV genotype 1 virus, specifically representative HCV 1A, 1B and 1C genotypes. Genbank database sequences for the coding region core-E1-E2 were aligned using Geneious software v5.6.4. Numbering of amino acids is according to strain NP_671941 (H77). Consensus: SEQ ID NO:1; AVI1a129: SEQ ID NO:2; NP_671491 (H77): SEQ ID NO:3; EU155269: SEQ ID NO:4; EU781810: SEQ ID NO:5; EU781771: SEQ ID NO:6; AB250610: SEQ ID NO:7; EU781752: SEQ ID NO:8; EU781759: SEQ ID NO:9; EF407439: SEQ ID NO:10; EF407427: SEQ ID NO:11; EU362905: SEQ ID NO:12; EF407413: SEQ ID NO:13; EU781808: SEQ ID NO:14; EU78170: SEQ ID NO:15; AJ238799 (Con1): SEQ ID NO:16; AAK97744: SEQ ID NO:17; AF139594: SEQ ID NO:18; AF176573: SEQ ID NO:19; BAA19625: SEQ ID NO:20; BAA25076: SEQ ID NO:21; BAC54896: SEQ ID NO:22; BAD91386: SEQ ID NO:23; BAF46764: SEQ ID NO:24; BAG30950: SEQ ID NO:25; CAB41951: SEQ ID NO:26; AAK95832: SEQ ID NO:27; AAT69968: SEQ ID NO:28; and BAA03581: SEQ ID NO:29.

FIG. 2A-2C provide an alignment of amino acid sequences of the core-E1-E2 coding region of representative HCV 2A and HCV2B subtypes. Genbank database sequences for the coding region core-E1-E2 were aligned using Geneious software v5.6.4. The amino acid numbering depicted is in accordance to the common HCV strains: ABO47639 (JFH1) and HPCJ8G-J8 (J8) for HCV2A and HCV2B, respectively. AB047639 (JFH1): SEQ ID NO:30; AB047645: SEQ ID NO:31; AF169003: SEQ ID NO:32; AF169005: SEQ ID NO:33; AF238482: SEQ ID NO:34; AY746460: SEQ ID NO:35; HPCPOLP: SEQ ID NO:36; NC_009823: SEQ ID NO:37; HPCJ8G HC-J8: SEQ ID NO:38; AB030907: SEQ ID NO:39; AY232730: SEQ ID NO:40; AY232747: SEQ ID NO:41; and DQ430817: SEQ ID NO:42.

FIG. 3A-3C provide an amino acid sequence alignment of the core-E1-E2 coding region for representative HCV 3A, 3B and 3K genotypes. Genbank database sequences for the coding region core-E1-E2 were aligned using Geneious software v5.6.4. Consensus: SEQ ID NO:43; AVI3a177: SEQ ID NO:44; YP_0014696: SEQ ID NO:45; CAA54244: SEQ ID NO:46; AAC03058: SEQ ID NO:47; AAY29642: SEQ ID NO:48; ABD85062: SEQ ID NO:49; ABD85063: SEQ ID NO:50; ABD97104: SEQ ID NO:51; BAA06044: SEQ ID NO:52; BAA08372: SEQ ID NO:53; and BAA09890: SEQ ID NO:54.

FIG. 5A-5C provide amino acid sequences of immunoglobulin Fc regions for GenBank 3S7G_A *Homo sapiens* IgG1 Fc: SEQ ID NOs.:140; GenBank AAN76044 *Homo sapiens* IgG2 Fc: SEQ ID NO: 141; GenBank AAW65947 *Homo sapiens* IgG3 Fc: SEQ ID NO:142; GenBank AAA52770 *Homo sapiens* IgD Fc: SEQ ID NO:143; GenBank 0308221A *Homo sapiens* IgM Fc: SEQ ID NO:144; GenBank P01876 *Homo sapiens* Iga Fc: SEQ ID NO:145; GenBank IF6A_B *Homo sapiens* IgE Fc: SEQ ID NO:146; and GenBank P01861 *Homo sapiens* IgG4 Fc: SEQ ID NO:147.

FIG. 6 presents Table 1, which provides conserved regions based on conserved CD4 epitopes ($CD4^+$ T cell epitopes) conserved among HCV genotypes. Top to Bottom: SEQ ID NOs.:148-158.

FIG. 7 presents Table 2, which provides the number of located HCV $CD8^+$ T cell epitopes and anchor positions for common human leukocyte antigen (HLA)-I Alleles in the United States.

FIG. 8 presents Table 3, which provides conserved regions based on CD8 epitopes ($CD8^+$ T cell epitopes) conserved among HCV genotypes. Top to Bottom: SEQ ID NOs.:159-168.

FIG. 9A-9B provide a list of CD4 and CD8 epitopes that are conserved among HCV genotypes 1a, 1b, 2a, 2b, and 3.

FIG. 10A-10D provide amino acid sequences of examples of polypeptides comprising multiple T-cell epitopes (TP29: SEQ ID NO:94; TP50: SEQ ID NO:99; TP52: SEQ ID NO:95; TP70: SEQ ID NO:96; TP100: SEQ ID NO:97; TP171: SEQ ID NO:89; TP228: SEQ ID NO:81; TP553: SEQ ID NO:100; TP778: SEQ ID NO:101; and TP1985: SEQ ID NO:102). The start and end amino acids are based on the sequence designated "Consensus" in FIG. 12A-12L. The T-cell epitopes contained within each polypeptide are provided; the T-cell epitope designations correspond to those presented in FIG. 11A-11N.

FIG. 12A-12L provide consensus amino acid sequences of HCV polypeptides (SEQ ID NOs.:170-181).

DEFINITIONS

Figure 1A:
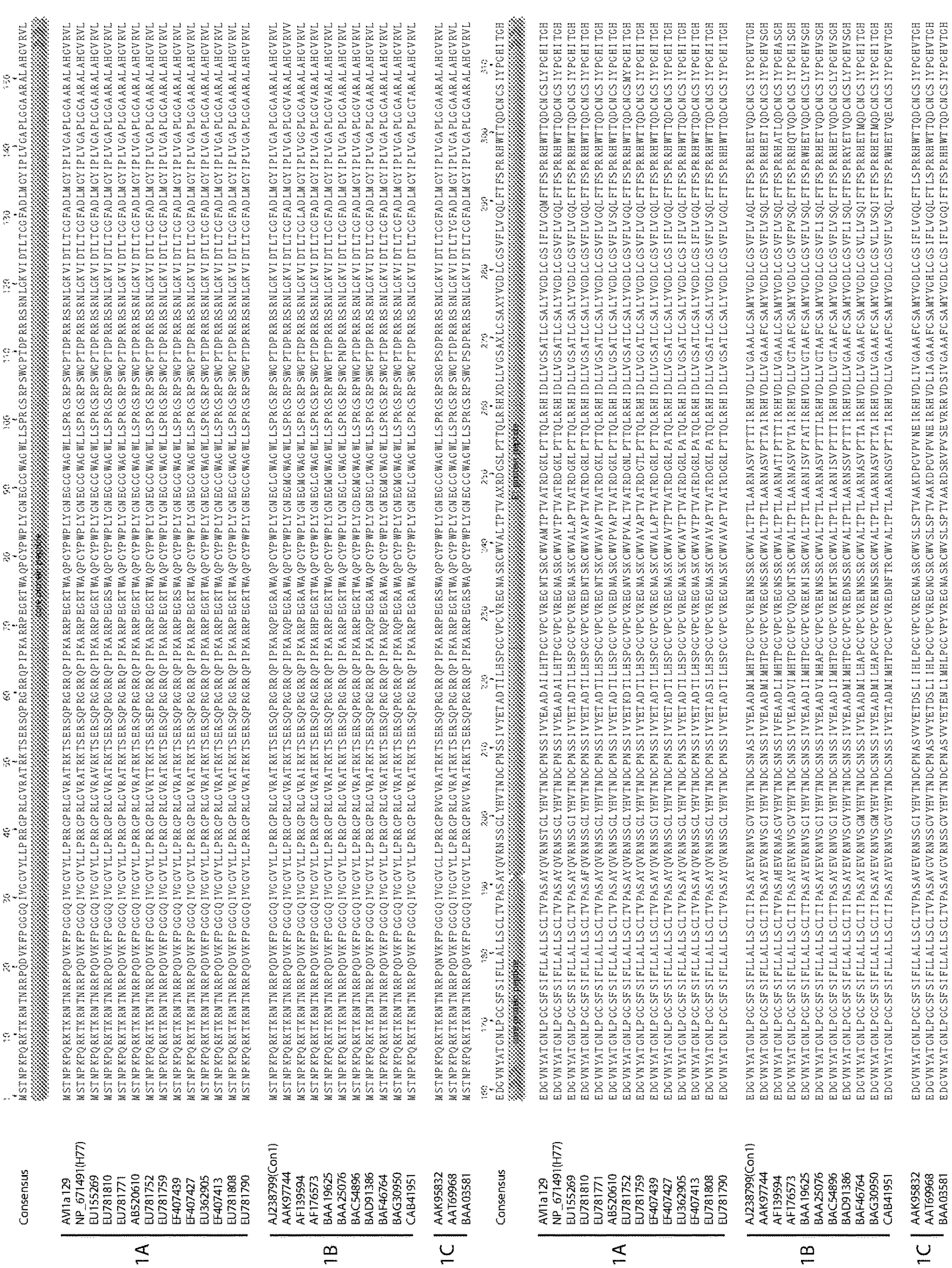

The term "hepatitis C virus" ("HCV"), as used herein, refers to any one of a number of different genotypes and isolates of hepatitis C virus. Thus, "HCV" encompasses any of a number of genotypes, subtypes, or quasispecies, of HCV, including, e.g., genotype 1, 2, 3, 4, 6, 7, etc. and subtypes (e.g., 1a, 1b, 2a, 2b, 3a, 4a, 4c, etc.), and quasispecies. Representative HCV genotypes and isolates include: the "Chiron" isolate HCV-1, H77, J6, Con1, isolate 1, BK, EC1, EC10, HC-J2, HC-J5; HC-J6, HC-J7, HC-J8, HC-JT, HCT18, HCT27, HCV-476, HCV-KF, "Hunan", "Japanese", "Taiwan", TH, type 1, type 1a, H77 type 1b, type 1c, type 1d, type 1e, type 1f, type 10, type 2, type 2a, type 2b, type 2c, type 2d, type 2f, type 3, type 3a, type 3b, type 3g, type 4, type 4a, type 4c, type 4d, type 4f, type 4h, type 4k, type 5, type 5a, type 6 and type 6a.

The terms "individual," "host," "subject," and "patient" are used interchangeably herein, and refer to a mammal, including, but not limited to, non-human primates (e.g., simians), equines (e.g., horses), rodents (e.g., rats; mice), and humans.

As used herein, the term "isolated," in reference to a polypeptide, refers to a polypeptide that is in an environment different from that in which the polypeptide naturally occurs. An isolated polypeptide can be purified. By "purified" is meant a compound of interest (e.g., a polypeptide) has been separated from components that accompany it in nature. "Purified" can also be used to refer to a polypeptide separated from components that can accompany it during production of the polypeptide (e.g., during synthesis in vitro, etc.). In some embodiments, a polypeptide (or a mixture of polypeptides) is substantially pure when the polypeptide (or mixture of polypeptides) is at least 60% or at least 75% by weight free from organic molecules with which it is naturally associated or with which it is associated during production. In some embodiments, the polypeptide is from 30% to 60% pure. In some embodiments, the polypeptide (or mixture of polypeptides) is at least 60%, at least 75%, at least 80%, at least 85%, at least 90%, at least 95%, or at least 99%, by weight, pure. For example, in some embodiments, an E1 or an E2 polypeptide (or a mixture of E1 and E2 polypeptides, e.g., an E1/E2 heterodimer) is substantially pure when the E1 or E2 polypeptide (or mixture of E1 and E2 polypeptides) is at least 60% or at least 75% by weight free from organic molecules with which the polypeptide(s) is naturally associated or with which it is associated during production. In some embodiments, the E1 or E2 polypeptide (or mixture of E1 and E2 polypeptides) is at least 60%, at least 75%, at least 80%, at least 85%, at least 90%, at least 95%, or at least 99%, by weight, pure. In some embodiments, where a composition comprises an E2 polypeptide, the E2 polypeptide is at least 60%, at least 75%, at least 80%, at least 85%, at least 90%, at least 95%, or at least 99%, by weight, pure. In some embodiments, where a composition comprises an E1/E2 heterodimeric complex polypeptide, the E1/E2 heterodimeric complex polypeptide is at least 60%, at least 75%, at least 80%, at least 85%, at least 90%, at least 95%, or at least 99%, by weight, pure. In some embodiments, where a composition comprises a T-cell epitope polypeptide, the T-cell epitope polypeptide is at least 60%, at least 75%, at least 80%, at least 85%, at least 90%, at least 95%, or at least 99%, by weight, pure.

The terms "polynucleotide" and "nucleic acid," used interchangeably herein, refer to a polymeric form of nucleotides of any length, either ribonucleotides or deoxyribonucleotides. Thus, this term includes, but is not limited to, single-, double-, or multi-stranded DNA or RNA, genomic DNA, cDNA, DNA-RNA hybrids, or a polymer comprising purine and pyrimidine bases or other natural, chemically or biochemically modified, non-natural, or derivatized nucleotide bases. In some cases, a polynucleotide is RNA. In some cases, a polynucleotide is DNA. A "polynucleotide" includes a nucleic acid that is incorporated into a viral vector or a bacterial vector.

The terms "peptide," "polypeptide," and "protein" are used interchangeably herein, and refer to a polymeric form of amino acids of any length, which can include coded and non-coded amino acids, chemically or biochemically modified or derivatized amino acids, and polypeptides having modified peptide backbones. The term "polypeptide" includes glycosylated polypeptides.

The term "heterologous" refers to two components that are defined by structures derived from different sources. For example, where "heterologous" is used in the context of a polypeptide, where the polypeptide includes operably linked amino acid sequences that can be derived from one or more different polypeptides, e.g., amino acid sequences that are not operably linked to the polypeptide in nature. As another example, where a composition comprises an HCV E1/E2 heterodimer and a "heterologous" polypeptide, the "heterologous polypeptide is a polypeptide other than HCV E1 or HCV E2. As another example, where a composition comprises an HCV E1 polypeptide and a "heterologous" polypeptide, the "heterologous polypeptide is a polypeptide other than HCV E1. As another example, where a composition comprises an HCV E2 polypeptide and a "heterologous" polypeptide, the "heterologous polypeptide is a polypeptide other than HCV E2.

Before the present invention is further described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise. Thus, for example, reference to "a T-cell epitope" includes a plurality of such epitopes and reference to "the E1/E2 heterodimer" includes reference to one or more E1/E2 heterodimers and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub-combination. All combinations of the embodiments pertaining to the invention are specifically embraced by the present invention and are disclosed herein just as if each and every combination was individually and explicitly disclosed. In addition, all sub-combinations of the various embodiments and elements thereof are also specifically embraced by the present invention and are disclosed herein just as if each and every such sub-combination was individually and explicitly disclosed herein.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

DETAILED DESCRIPTION

The present disclosure provides an immunogenic composition comprising; a) an HCV heterodimeric polypeptide that includes HCV E1 and E2 polypeptides; b) a heterologous polypeptide (a T-cell epitope polypeptide) comprising T-cell epitopes present in an HCV protein other than E1 and E2; and c) a pharmaceutically acceptable excipient. The present disclosure provides an immunogenic composition comprising; a) an HCV E2 polypeptide; b) a heterologous polypeptide (a T-cell epitope polypeptide) comprising T-cell epitopes present in an HCV protein other than E1 and E2; and c) a pharmaceutically acceptable excipient. The present disclosure provides an immunogenic composition comprising; a) an HCV E1 polypeptide; b) a heterologous polypeptide (a T-cell epitope polypeptide) comprising T-cell epitopes present in an HCV protein other than E1 and E2; and c) a pharmaceutically acceptable excipient. T-cell epitopes that are present in a heterologous polypeptide suitable for inclusion in an immunogenic composition of the present disclosure include $CD4^+$ and $CD8^+$ T-cell epitopes that are conserved among heterogeneous HCV genotypes and that are presented through multiple HLA alleles common within the human population. The present disclosure provides a method of inducing an immune response, in an individual, to an HCV polypeptide. The present disclosure provides an immunogenic composition comprising: a) polypeptide comprising T-cell epitopes present in an HCV protein other than E1 and E2; and b) a pharmaceutically acceptable excipient. T-cell epitopes that are present in the polypeptide include $CD4^+$ and $CD8^+$ T-cell epitopes that are conserved among heterogeneous HCV genotypes and that are presented through multiple HLA alleles common within the human population.

In some cases, an immunogenic composition of the present disclosure comprises, as separate entities: a) an HCV E1/E2 heterodimer; and b) a heterologous polypeptide comprising a T-cell epitope present in an HCV protein other than E1 and E2. In some cases, an immunogenic composition of the present disclosure comprises, as separate entities: a) an HCV E2 polypeptide; and b) a heterologous polypeptide comprising a T-cell epitope present in an HCV protein other than E1 and E2. In some cases, an immunogenic composition of the present disclosure comprises, as separate entities: a) an HCV E1 polypeptide; and b) a heterologous polypeptide comprising a T-cell epitope present in an HCV protein other than E1 and E2.

As noted above, T-cell epitopes that are present in a heterologous polypeptide suitable for inclusion in an immunogenic composition of the present disclosure include $CD4^+$ and $CD8^+$ T-cell epitopes that are conserved among heterogeneous HCV genotypes and that are presented through multiple HLA alleles common within the human population. Thus, a heterologous polypeptide suitable for inclusion in an immunogenic composition of the present disclosure comprises multiple (e.g., 2, 3, 4, 5, 6, 7, 8, 9, 10, or more than 10) $CD4^+$ and $CD8^+$ T-cell epitopes that are conserved among heterogeneous HCV genotypes and that are presented through multiple HLA alleles common within the human population.

A suitable heterologous polypeptide comprises an amino acid sequence having at least 20% amino acid sequence identity to a polypeptide depicted in any one of FIGS. 9A, 9B, 10A-10D, and 11A-11N. The heterologous polypeptide can be expressed in any suitable host cell e.g., a bacterial host cell, a yeast host cell, an insect host cell, a mammalian host cell) as a separate polypeptide, then combined with a E1/E2 heterodimer, an E2 polypeptide, or an E1 polypeptide, to form and immunogenic composition. The heterologous polypeptides serve to elicit broad spectrum $CD4^+$ and $CD8^+$ T cell responses to multiple HCV genotypes because the heterologous polypeptides have been selected to contain a plurality of T cell epitopes that are highly conserved among the hepacivirus genus, many of which are immunodominant. The heterologous polypeptides also contain T cell epitopes presented by various MHC alleles common in the human population. The E1/E2 antigens will also elicit cross-reactive T cell responses; however, the heterologous polypeptides will elicit broader T cell responses that are cross-reactive with multiple HCV genotypes in the general human population. Both neutralizing antibodies and T cell responses are known to be protective against HCV; thus, this combination of antigens, optionally along with a suitable adjuvant (e.g., AS01 or MF59 or Alum/MPL) will optimize the protective effects of a HCV vaccine.

The heterologous polypeptides may be expressed alone (e.g., without any heterologous polypeptide appended thereto), and then purified conventionally. Alternatively, the heterologous polypeptides can be expressed downstream of, or upstream of, an immunoglobulin (Ig) Fc fragment (or other affinity tag) separated by a protease cleavage site (e.g., a Precision protease cleavage site) and then purified. The heterologous polypeptides can also be chemically-synthesised.

Compositions Comprising: A) an HCV E1/E2 Heterodimer, an HCV E2 Polypeptide, or an HCV E1 Polypeptide; and B) a Heterologous Polypeptide Comprising a T-Cell Epitope The present disclosure provides an immunogenic composition comprising: a) a hepatitis C virus (HCV) heterodimeric polypeptide comprising: i) an HCV E1 polypeptide; and ii) an HCV E2 polypeptide; b) a heterologous polypeptide comprising a T-cell epitope present in an HCV protein other than E1 and E2; and c) a pharmaceutically acceptable carrier. In some cases, the immunogenic composition comprises an adjuvant. The present disclosure provides an immunogenic composition comprising: a) an HCV E2 polypeptide; b) a heterologous polypeptide comprising a T-cell epitope present in an HCV protein other than E1 and E2; and c) a pharmaceutically acceptable carrier. The present disclosure provides an immunogenic composition comprising: a) an HCV E1 polypeptide; b) a heterologous polypeptide comprising a T-cell epitope present in an HCV protein other than E1 and E2; and c) a pharmaceutically acceptable carrier. As noted above, T-cell epitopes that are present in a heterologous polypeptide suitable for inclusion in an immunogenic composition of the present disclosure include $CD4^+$ and $CD8^+$ T-cell epitopes that are conserved among heterogeneous HCV genotypes and that are presented through multiple HLA alleles common within the human population. Thus, a heterologous polypeptide suitable for inclusion in an immunogenic composition of the present disclosure comprises multiple (e.g., 2, 3, 4, 5, 6, 7, 8, 9, 10, or more than 10) $CD4^+$ and $CD8^+$ T-cell epitopes that are conserved among heterogeneous HCV genotypes and that are presented through multiple HLA alleles common within the human population. In some cases, the immunogenic composition comprises an adjuvant.

In some cases, an immunogenic composition of the present disclosure, when administered to an individual in need thereof, induces an immune response in the individual to one or more HCV genotypes. In some cases, an immunogenic composition of the present disclosure, when administered to an individual in need thereof, induces an immune response in the individual to one or more HCV genotypes, where the immune response is greater than the immune response induced by administration of a control composition comprising the HCV E1/E2 heterodimer (or E1 polypeptide, or E2 polypeptide) but lacking the heterologous polypeptide.

In some cases, an immunogenic composition of the present disclosure, when administered to an individual in need thereof, induces $CD8^+$ CTLs specific for HCV, where the number of HCV-specific $CD8^+$ CTLs induced is at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, higher than the number of HCV-specific $CD8^+$ CTLs induced by administration of a control composition (e.g., a composition comprising the HCV E1/E2 heterodimer but lacking the heterologous polypeptide; a composition comprising an E1 polypeptide but lacking the heterologous polypeptide; a composition comprising an E2 polypeptide but lacking the heterologous polypeptide).

In some cases, an immunogenic composition of the present disclosure, when administered to an individual in need thereof, induces $CD4^+$ T cells specific for HCV, where the number of HCV-specific $CD4^+$ T cells induced is at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, higher than the number of HCV-specific $CD4^+$ T cells induced by administration of a control composition (e.g., a composition comprising the HCV E1/E2 heterodimer but lacking the heterologous polypeptide; a composition comprising an E1 polypeptide but lacking the heterologous polypeptide; a composition comprising an E2 polypeptide but lacking the heterologous polypeptide).

In some cases, an immunogenic composition of the present disclosure, when administered to an individual in need thereof, induces production of HCV-specific $CD4^+$ T cells and $CD8^+$ T cells in the individual, where the number of HCV-specific $CD4^+$ T cells and/or $CD8^+$ T cells is increased, such that the percent of total peripheral $CD4^+$ and/or $CD8^+$ T cells that is HCV-specific is from 0.01% to 0.05%, from 0.05% to 0.10%, from 0.10% to 0.125%, from 0.125% to 0.25%, from 0.25% to from 0.50%, or 0.5% to 10% (e.g., from 0.5% to 1%, from 1% to 2%, from 2% to 5%, or from 5% to 10%). The number of HCV-specific $CD4^+$ T cells and $CD8^+$ T cells in a control individual (e.g., an individual not infected with HCV) not treated with the immunogenic composition would be undetectable.

In some cases, an immunogenic composition of the present disclosure, when administered to an individual in need thereof, induces production of HCV NS3-specific $CD4^+$ T cells and/or $CD8^+$ T cells in the individual, where the number of HCV NS3-specific $CD4^+$ T cells and/or $CD8^+$ T cells is increased, such that the percent of the total peripheral blood T cells (i.e., the total number of $CD4^+$ T cells+$CD8^+$ T cells in the peripheral blood) that are HCV NS3-specific $CD4^+$ T cells and $CD8^+$ T cells is from 0.01% to 10% (e.g., from 0.01% to 0.05%, from 0.05% to 0.1%, from 0.1% to 0.25%, from 0.25% to 0.5%, from 0.5% to 1%, from 1% to 2%, from 2% to 5%, or from 5% to 10%). The number of HCV NS3-specific $CD4^+$ T cells and $CD8^+$ T cells in a control individual (e.g., an individual not infected with HCV) not treated with the immunogenic composition would be undetectable.

In some cases, an immunogenic composition of the present disclosure, when administered to an individual in need thereof, increases the number of HCV E1/E2-specific $CD4^+$ T cells and $CD8^+$ T cells in the individual by at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, compared to the number of HCV E1/E2-specific $CD4^+$ T cells and $CD8^+$ T cells in the individual induced by administration of a control composition comprising the HCV E1/E2 heterodimer but lacking the heterologous polypeptide, or compared to the number of HCV E1/E2-specific $CD4^+$ T cells and $CD8^+$ T cells in the individual before administration of the immunogenic composition.

In some cases, an immunogenic composition of the present disclosure, when administered to an individual in need thereof, induces helper T lymphocytes (e.g., $CD4^+$ T cells) specific for HCV, where the number of HCV-specific helper T lymphocytes induced is at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, higher than the number of HCV-specific helper T cells induced by administration of a control composition comprising the HCV E1/E2 heterodimer but lacking the heterologous polypeptide, or compared to the number of HCV-specific $CD4^+$ T cells in the individual before administration of the immunogenic composition.

In some cases, an immunogenic composition of the present disclosure, when administered to an individual in need thereof, induces antibody specific for HCV, where the level of HCV-specific antibody induced is at least at high as the level of HCV-specific antibody induced by administration of a control composition comprising the HCV E1/E2 heterodimer but lacking the heterologous polypeptide.

In some cases, an immunogenic composition of the present disclosure, when administered to an individual in need thereof, induces antibody specific for HCV, where the level of HCV-specific antibody induced is at least 10%, at least 15%, at least 20%, at least 25%, at least 30%, at least 40%, at least 50%, at least 75%, at least 100% (or 2-fold), at least 2.5-fold, at least 5-fold, at least 7.5-fold, at least 10-fold, at least 20-fold, at least 50-fold, or at least 100-fold, or more than 100-fold, higher than the level of HCV-specific antibody induced by administration of a control composition comprising the HCV E1/E2 heterodimer but lacking the heterologous polypeptide, or compared the level of HCV-specific antibody in the individual before administration of the immunogenic composition.

An immunogenic composition of the present disclosure, when administered to an individual in need thereof, induces an immune response (e.g., a cellular immune response) in the individual to one or more HCV genotypes. In some cases, an immunogenic composition of the present disclosure, when administered to an individual in need thereof, induces an immune response in the individual to HCV genotype 1. In some cases, an immunogenic composition of the present disclosure, when administered to an individual in need thereof, induces an immune response in the individual to HCV genotype 2. In some cases, an immunogenic composition of the present disclosure when administered to an individual in need thereof, induces an immune response in the individual to HCV genotype 3. In some cases, an immunogenic composition of the present disclosure, when administered to an individual in need thereof, induces an immune response in the individual to HCV genotype 1 and HCV genotype 3. In some cases, an immunogenic composition of the present disclosure, when administered to an individual in need thereof, induces an immune response in the individual to HCV genotype 1, HCV genotype 2, and HCV genotype 3. In some cases, an immunogenic composition of the present disclosure, when administered to an individual in need thereof, induces an immune response in the individual to HCV genotype 1, HCV genotype 2, HCV genotype 3, and HCV genotype 7. In some cases, an immunogenic composition of the present disclosure, when administered to an individual in need thereof, induces an immune response in the individual to HCV genotype 1, HCV genotype 2, HCV genotype 3, HCB genotype 4, HCV genotype 5, HCV genotype 6, and HCV genotype 7.

HCV E1/E2 Heterodimers; HCV E2 Polypeptides; HCV E1 Polypeptides

HCV E1/E2 heterodimers suitable for use in an immunogenic composition of the present disclosure include HCV E1/E2 heterodimers comprising wild-type HCV E1 polypeptides; HCV E1/E2 heterodimers comprising wild-type HCV E2 polypeptides; HCV E1/E2 heterodimers comprising variant HCV E1 polypeptides; and HCV E1/E2 heterodimers comprising variant HCV E2 polypeptides. HCV E2 polypeptides suitable for use in an immunogenic composition of the present disclosure include wild-type E2 polypeptides and variant E2 polypeptides. HCV E1 polypeptides suitable for use in an immunogenic composition of the present disclosure include wild-type E1 polypeptides and variant E1 polypeptides.

E2 Polypeptides

An E2 polypeptide suitable for inclusion in an E1/E2 heterodimer for inclusion in an immunogenic composition of the present disclosure, or for inclusion by itself in an immunogenic composition of the present disclosure, can have a length of from about 200 amino acids (aa) to about 250 aa, from about 250 aa to about 275 aa, from about 275 aa to about 300 aa, from about 300 aa to about 325 aa, from about 325 aa to about 350 aa, or from about 350 aa to about 365 aa. In some cases, an HCV E2 polypeptide suitable for inclusion in an immunogenic composition of the present disclosure is an HCV E2 ectodomain polypeptide. In some cases, an HCV E2 polypeptide suitable for inclusion in an immunogenic composition of the present disclosure is a full-length HCV E2 polypeptide.

Figure 2A:
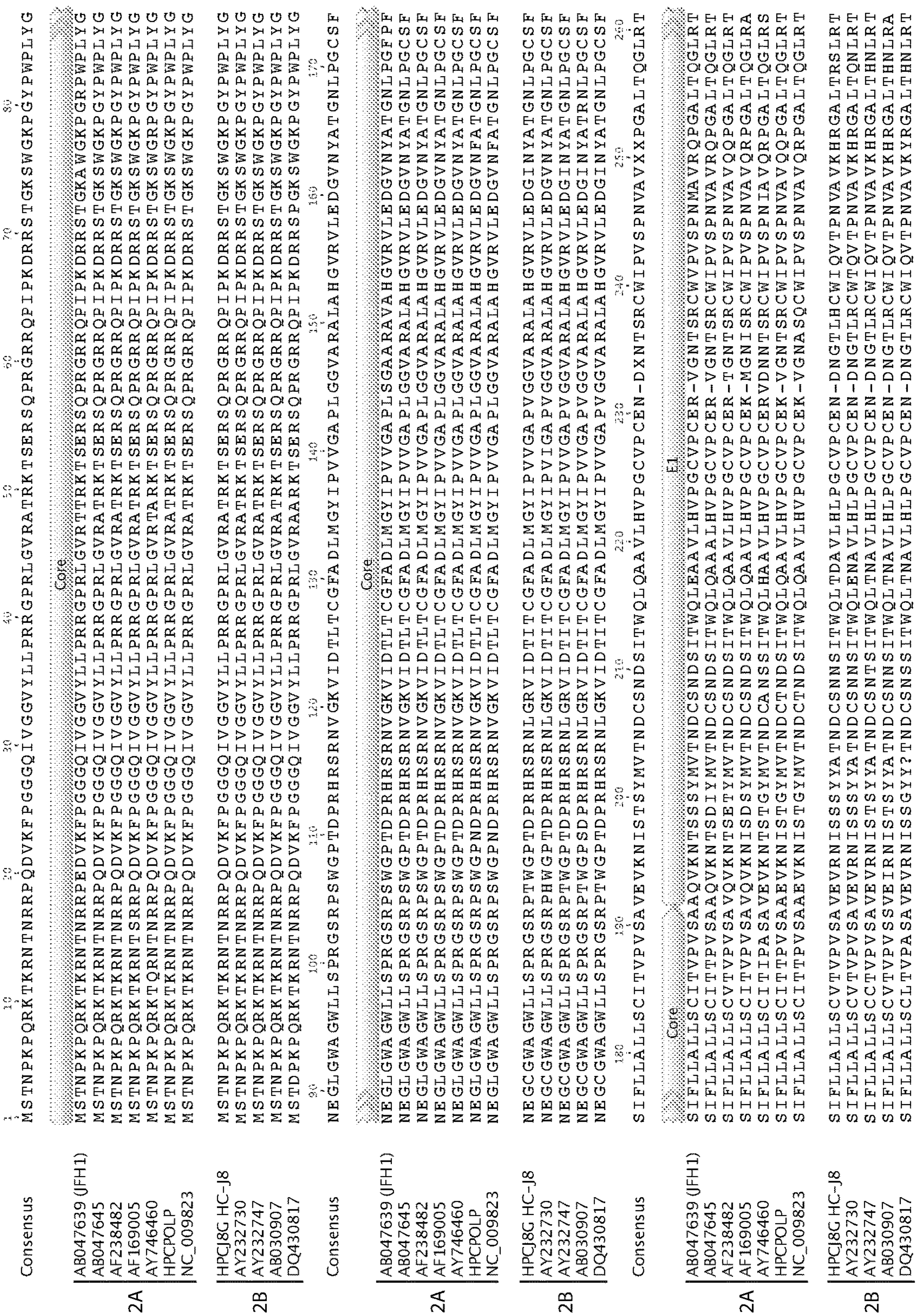
Figure 3C:
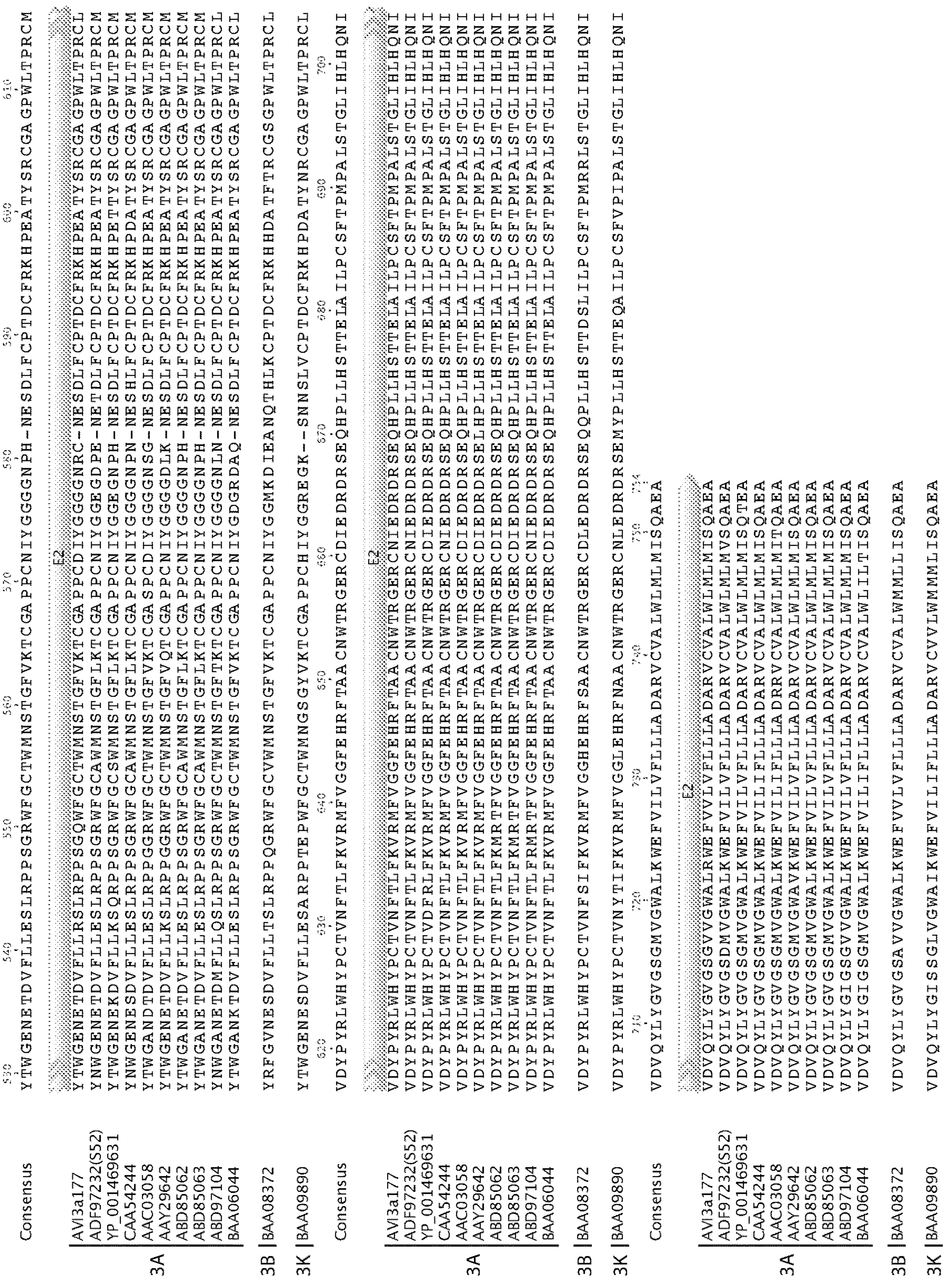
Figure 4A:
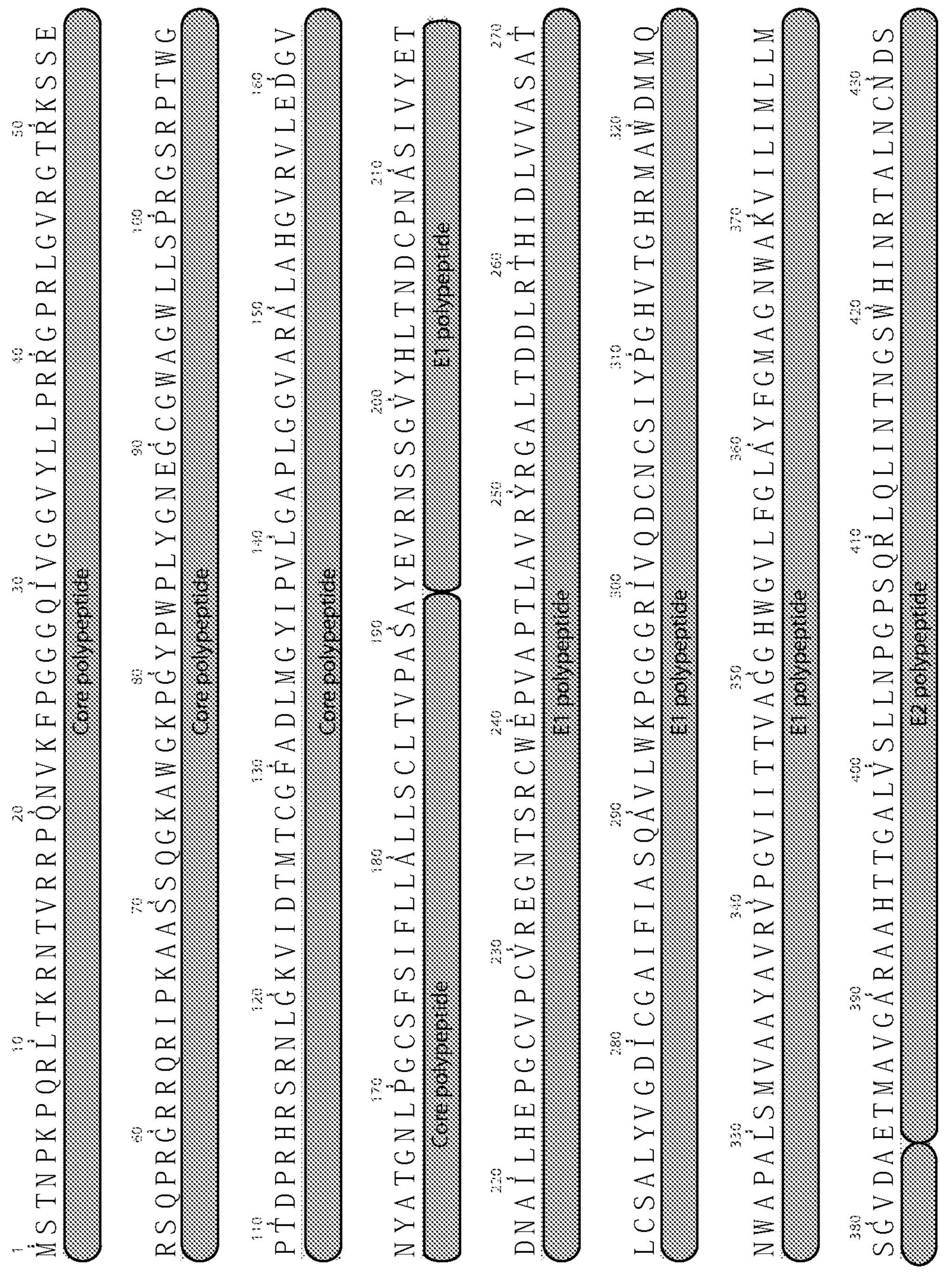
FIG. 4A-4B provide an amino acid sequence of the core-E1-E2 coding region for HCV genotype 7a. Amino acid sequence for the coding region core-E1-E2 of genotype 7a (isolate QC69; Genbank: ABN05226.1; SEQ ID NO:55) is shown according to the numbering scheme of the reference strain, NP_671941 (H77).
Figure 4B:
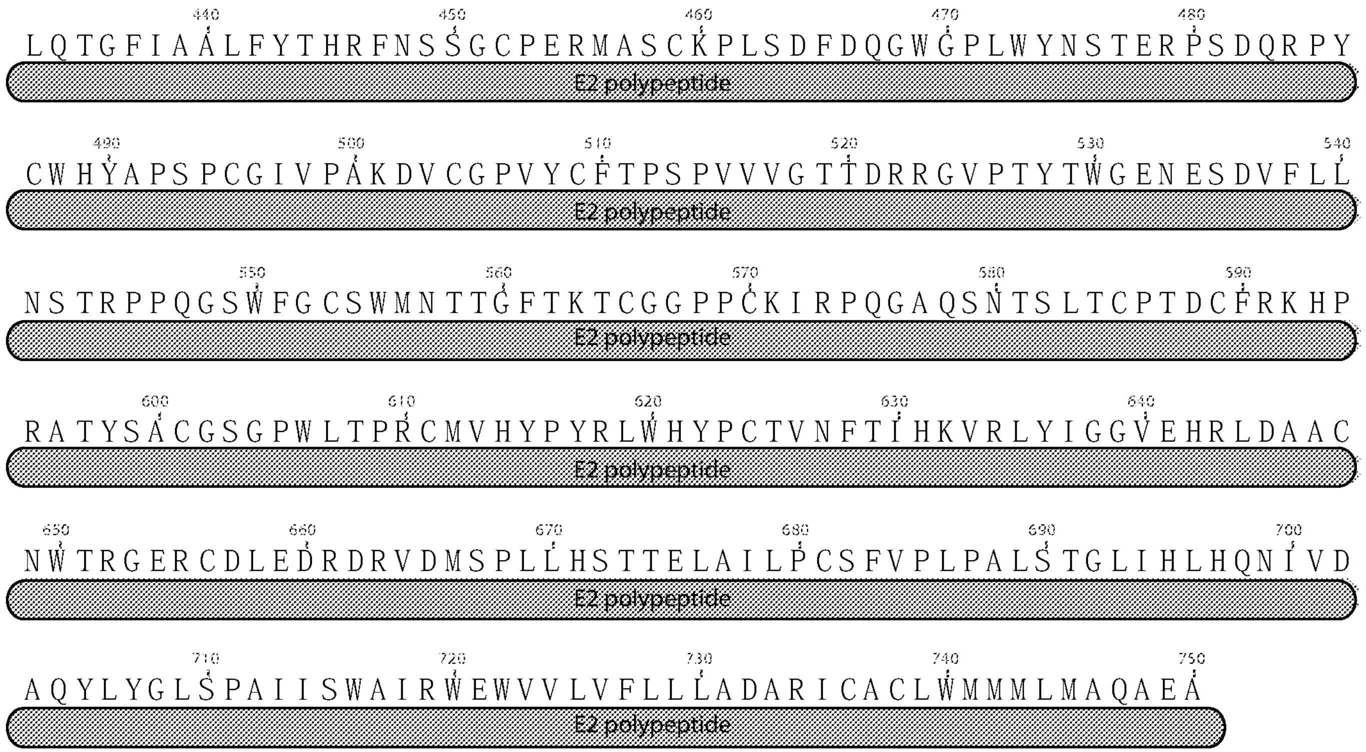

In FIG. 1A-AC, the amino acid sequence of E2 is amino acid 384 to amino acid 746. In FIG. 2A-2B, the amino acid sequence of E2 is amino acid 384 to amino acid 751. In FIG. 3A-3C, the amino acid sequence of E2 is amino acid 385 to amino acid 754. In FIG. 4A-4B, the amino acid sequence of E2 is amino acid 384 to amino acid 750. As used herein, an "E2 polypeptide" includes a precursor E2 protein, including the signal sequence; includes a mature E2 polypeptide which lacks this sequence; and includes an E2 polypeptide with a heterologous signal sequence. An E2 polypeptide can include a C-terminal membrane anchor sequence which occurs at approximately amino acid positions 715-730 and may extend as far as approximately amino acid residue 746 (see, Lin et al., J. Virol. (1994) 68:5063-5073).

Figure 1B:
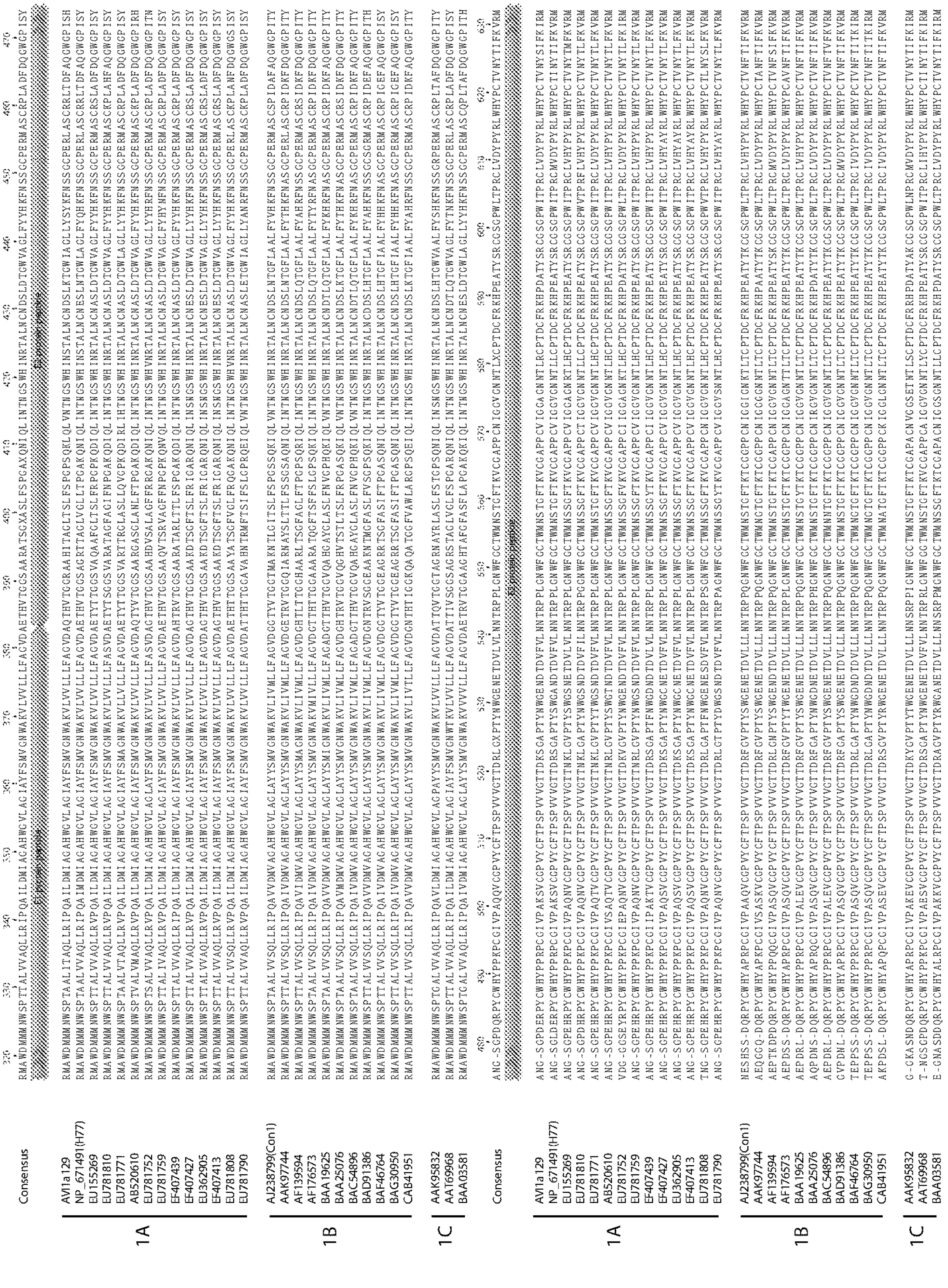

In some cases, a E2 polypeptide suitable for inclusion in an immunogenic composition of the present disclosure lacks a portion of its C-terminal region, e.g., from about amino acid 715 to the C-terminus; from about amino acid 625 to the C-terminus; from about amino acid 661 to the C-terminus; from about amino acid 655 to the C-terminus; from about amino acid 500 to the C-terminus, where the amino acid numbering is with reference to the numbering in FIG. 1A-1C. See, e.g., U.S. Pat. No. 6,521,423.

An E2 polypeptide suitable for inclusion in an immunogenic composition of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIG. 1A-1C, FIG. 2A-2C, FIG. 3A-3C, or FIG. 4A-4B. An E2 polypeptide suitable for inclusion in an immunogenic composition of the present disclosure can comprise an amino acid sequence having at least about 20%, at least about 25%, at least about 30%, at least about 35%, at least about 40%, at least about 45%, at least about 50%, at least about 60%, at least about 70%, or at least about 75%, amino acid sequence identity to an amino acid sequence of an E2 polypeptide depicted in FIG. 1A-1C, FIG. 2A-2C, FIG. 3A-3C, or FIG. 4A-4B.

An E2 polypeptide suitable for inclusion in an immunogenic composition of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIG. 1A-1C. For example, an E2 polypeptide of genotype 1 can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence depicted in FIG. 1A-1C. For example, an E2 polypeptide of genotype 1A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence identified as 1A and depicted in FIG. 1A-1C. For example, an E2 polypeptide of genotype 1B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence identified as 1B and depicted in FIG. 1A-1C. For example, an E2 polypeptide of genotype 1C can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-746 of an amino acid sequence identified as 1C and depicted in FIG. 1A-1C.

Figure 2C:
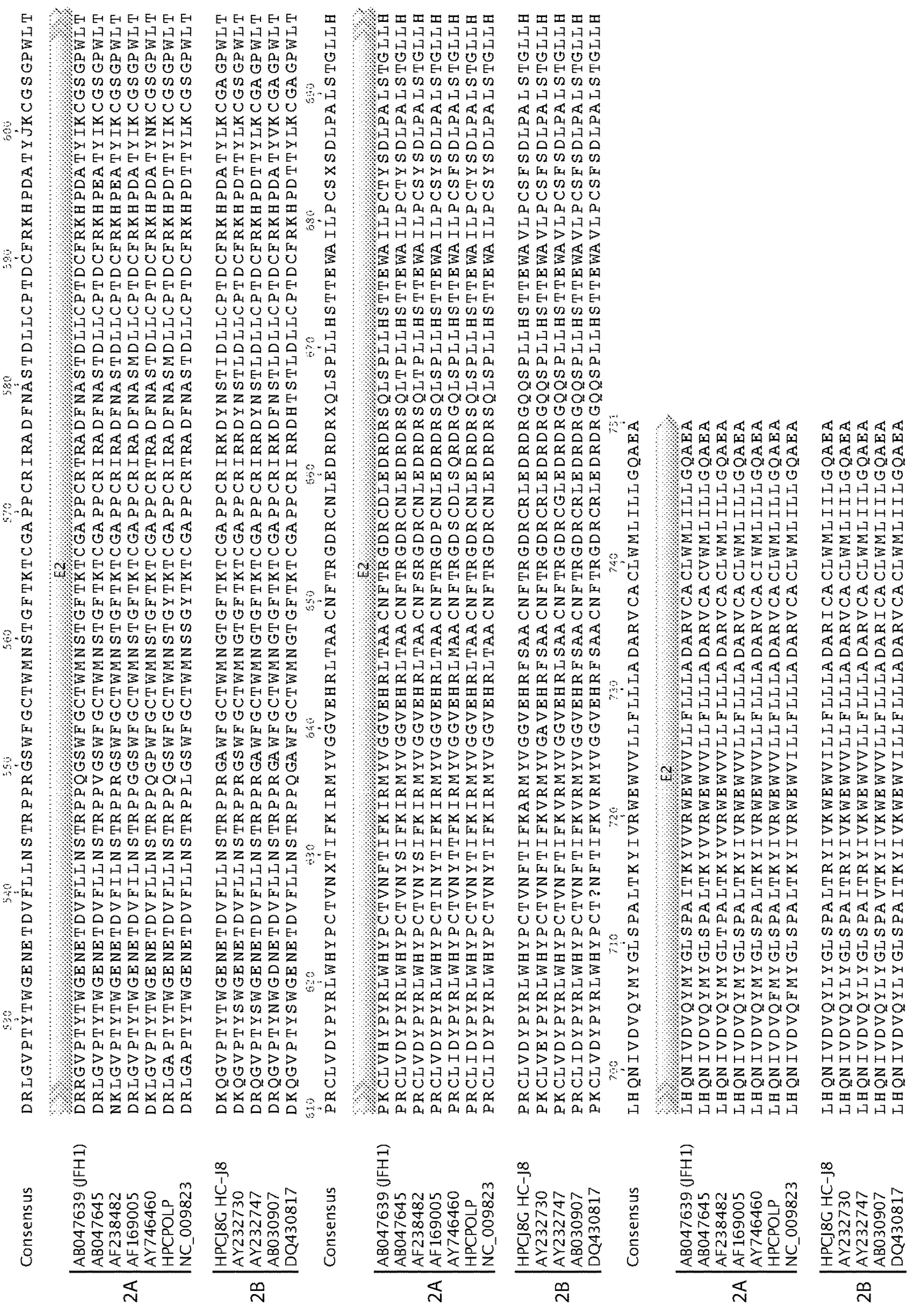

An E2 polypeptide suitable for inclusion in an immunogenic composition of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIG. 2A-2C. For example, an E2 polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-751 of an amino acid sequence depicted in FIG. 2A-2C. For example, an E2 polypeptide of genotype 2A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-751 of the "consensus" amino acid sequence depicted in FIG. 2A-2C. For example, an E2 polypeptide of genotype 2B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-751 of the "consensus" amino acid sequence depicted in FIG. 2A-2C.

An E2 polypeptide suitable for inclusion in an immunogenic composition of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E2 polypeptide depicted in FIG. 3A-3C. For example, an E2 polypeptide of genotype 3 can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of an amino acid sequence depicted in FIG. 3A-3C. For example, an E2 polypeptide of genotype 3A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of an amino acid sequence identified as 3A and depicted in FIG. 3A-3C. For example, an E2 polypeptide of genotype 3B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of the amino acid sequence identified as 3B and depicted in FIG. 3A-3C. For example, an E2 polypeptide of genotype 3K can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 385-754 of the amino acid sequence identified as 3K and depicted in FIG. 3A-3C.

An E2 polypeptide suitable for inclusion in an immunogenic composition of the present disclosure can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the amino acid sequence of the E2 polypeptide depicted in FIG. 4A-4B. For example, an E2 polypeptide of genotype 7A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 384-750 of the amino acid sequence depicted in FIG. 4A-4B.

E1 Polypeptides

An HCV E1 polypeptide suitable for inclusion in an E1/E2 heterodimer for inclusion in an immunogenic composition of the present disclosure, or for inclusion by itself in an immunogenic composition of the present disclosure, can have a length of from about 100 amino acids (aa) to about 150 aa, from about 150 aa to about 175 aa, from about 175 aa to about 195 aa, from about 131 aa to about 175 aa, or from about 175 aa to about 193 aa. In some cases, an HCV E1 polypeptide suitable for inclusion in an E1/E2 heterodimer present in an immunogenic composition of the present disclosure is an HCV E1 ectodomain polypeptide. In some cases, an HCV E1 polypeptide suitable for inclusion in an E1/E2 heterodimer present in an immunogenic composition of the present disclosure is a full-length HCV E1 polypeptide.

In FIG. 1A-1C, the amino acid sequence of E1 is amino acid 192 to amino acid 383. In FIG. 2A-2C, the amino acid sequence of E1 is amino acid 192 to amino acid 383. In FIG. 3A-3C, the amino acid sequence of E1 is amino acid 192 to amino acid 384. In FIG. 4A-4B, the amino acid sequence of E1 is amino acid 192 to amino acid 383. Amino acids at around 170 through approximately 191 serve as a signal sequence for E1. As used herein, "E1 polypeptide" includes a precursor E1 protein, including the signal sequence; includes a mature E1 polypeptide which lacks this sequence; and includes an E1 polypeptide with a heterologous signal sequence. An E1 polypeptide can include a C-terminal membrane anchor sequence which occurs at approximately amino acid positions 360-383 (see, e.g., WO 96/04301). In some cases, a suitable E1 polypeptide lacks a C-terminal portion that includes a transmembrane region. For example, in some cases, a suitable E1 polypeptide lacks the C-terminal portion from amino acid 330 to amino acid 384, or from amino acid 360 to amino acid 384. E1 polypeptides can be an E1 polypeptide of any genotype, subtype or isolate of HCV. E1 polypeptides of genotype 1 and E1 polypeptides of genotype 3 are included in an E1/E2 heterodimer of the present disclosure.

An E1 polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIG. 1A-1C, FIG. 2A-2C, FIG. 3A-3C, or FIG. 4A-4B.

An E1 polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIG. 1A-1C. For example, an E1 polypeptide of genotype 1A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 1A and depicted in FIG. 1A-1C. For example, an E1 polypeptide of genotype 1B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 1B and depicted in FIG. 1A-1C. For example, an E1 polypeptide of genotype 1C can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 1C and depicted in FIG. 1A-1C.

An E1 polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIG. 2A-2C. For example, an E1 polypeptide of genotype 2A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 2A and depicted in FIG. 2A-2C. For example, an E1 polypeptide of genotype 2B can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of an amino acid sequence identified as 2B and depicted in FIG. 2A-2C.

An E1 polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the consensus E1 polypeptide amino acid sequence depicted in FIG. 3A-3C.

An E1 polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to an amino acid sequence of an E1 polypeptide depicted in FIG. 4A-4B. For example, an E1 polypeptide of genotype 7A can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 192-383 of the amino acid sequence depicted in FIGS. 4A-4B.

HCV E1 and E2 Polypeptides Comprising Amino Acids from a Proteolytically Cleavable Linker As described in more detail below, an HCV E1/E2 heterodimer can be generated using a method that involves an HCV E1 or an HCV E2 polypeptide comprising a heterologous proteolytically cleavable linker. Following enzymatic cleavage of the proteolytically cleavable linker, from 1 to 6 (e.g., 1, 2, 3, 4, 5, or 6) heterologous amino acids can remain on the HCV E1 or E2 polypeptide. For example, from 1 to 6 (e.g., 1, 2, 3, 4, 5, or 6) heterologous amino acids can remain at the N-terminus of an HCV E2 polypeptide. As another example, from 1 to 6 (e.g., 1, 2, 3, 4, 5, or 6) heterologous amino acids can remain at the C-terminus of an HCV E2 polypeptide. As another example, from 1 to 6 (e.g., 1, 2, 3, 4, 5, or 6) heterologous amino acids can remain at the N-terminus of an HCV E1 polypeptide. As another example, from 1 to 6 (e.g., 1, 2, 3, 4, 5, or 6) heterologous amino acids can remain at the C-terminus of an HCV E1 polypeptide.

In some cases, amino acids C-terminal to the proteolytic cleavage site in a proteolytically cleavable linker are Gly-Pro, Ser, Gly, or Gly-Ser. Thus, in some cases, a modified HCV E1 polypeptide comprises, appended to the N-terminus of an HCV E1 polypeptide: Gly-Pro, Ser, Gly, or Gly-Ser. In other words, in some cases, a modified HCV E1 polypeptide comprises, in order from N-terminus to C-terminus: a) Gly-Pro, Ser, Gly, or Gly-Ser; and b) an HCV E1 polypeptide.

In some cases, amino acids C-terminal to the proteolytic cleavage site in a proteolytically cleavable linker are Gly-Pro, Ser, Gly, or Gly-Ser. Thus, in some cases, a modified HCV E2 polypeptide comprises, appended to the N-terminus of an HCV E2 polypeptide: Gly-Pro, Ser, Gly, or Gly-Ser. In other words, in some cases, a modified HCV E2 polypeptide comprises, in order from N-terminus to C-terminus: a) Gly-Pro, Ser, Gly, or Gly-Ser; and b) an HCV E2 polypeptide.

In some cases, amino acids N-terminal to the proteolytic cleavage site in a proteolytically cleavable linker are LEVLFQ (SEQ ID NO:76), ENLYYFQ (SEQ ID NO:83), LVPR (SEQ ID NO:78), I(E/D)GR (SEQ ID NO:90), or DDDDK (SEQ ID NO:77). Thus, in some cases, a modified HCV E1 polypeptide comprises, appended to the C-terminus of an HCV E1 polypeptide: LEVLFQ (SEQ ID NO:76), ENLYYFQ (SEQ ID NO:83), LVPR (SEQ ID NO:78), I(E/D)GR (SEQ ID NO:90), or DDDDK (SEQ ID NO:77). In other words, in some cases, a modified HCV E1 polypeptide comprises, in order from N-terminus to C-terminus: a) an HCV E1 polypeptide; and b) LEVLFQ (SEQ ID NO:76), ENLYYFQ (SEQ ID NO:83), LVPR (SEQ ID NO:78), I(E/D)GR (SEQ ID NO:90), or DDDDK (SEQ ID NO:77).

In some cases, amino acids N-terminal to the proteolytic cleavage site in a proteolytically cleavable linker are LEVLFQ (SEQ ID NO:76), ENLYYFQ (SEQ ID NO:83), LVPR (SEQ ID NO:78), I(E/D)GR (SEQ ID NO:90), or DDDDK (SEQ ID NO:77). Thus, in some cases, a modified HCV E2 polypeptide comprises, appended to the C-terminus of an HCV E2 polypeptide: LEVLFQ (SEQ ID NO:76), ENLYYFQ (SEQ ID NO:83), LVPR (SEQ ID NO:78), I(E/D)GR (SEQ ID NO:90), or DDDDK (SEQ ID NO:77). In other words, in some cases, a modified HCV E2 polypeptide comprises, in order from N-terminus to C-terminus: a) an HCV E2 polypeptide; and b) LEVLFQ (SEQ ID NO:76), ENLYYFQ (SEQ ID NO:83), LVPR (SEQ ID NO:78), I(E/D)GR (SEQ ID NO:90), or DDDDK (SEQ ID NO:77).

In some cases, a flexible linker of from 1 to 10 amino acids is interposed between the proteolytically cleavable linker and the HCV E1 or E2 polypeptide. Flexible linkers are intrinsically disordered flexible linker domains or loops that vary in length and can be rich in polar uncharged amino acids. Flexible linkers include, e.g., glycine polymers $(G)_n$, glycine-serine polymers (including, for example, $(GS)_n$, $(GSGGS)_n$ (SEQ ID NO:56), $(GGSGGS)_n$ (SEQ ID NO:57), and $(GGGS)_n$ (SEQ ID NO:58), where n is an integer of at least one, e.g., where n is 1, 2, 3, 4, 5, or 6); glycine-alanine polymers, such as GAGAGAGA and the like; and alanine-serine polymers, e.g., SASASASA and the like. Exemplary linkers can comprise amino acid sequences including, but not limited to, GGSG (SEQ ID NO:59), GGSGG (SEQ ID NO:60), GSGSG (SEQ ID NO:61), GSGGG (SEQ ID NO:62), GGGSG (SEQ ID NO:63), GSSSG (SEQ ID NO:64), and the like.

For example, in some cases, a modified E1 polypeptide comprises, in order from N-terminus to C-terminus: a) Gly-Pro, Ser, Gly, or Gly-Ser; b) a flexible linker of from 1 to 10 amino acids; and c) an HCV E1 polypeptide.

As another example, in some cases, a modified E2 polypeptide comprises, in order from N-terminus to C-terminus: a) Gly-Pro, Ser, Gly, or Gly-Ser; b) a flexible linker of from 1 to 10 amino acids; and c) an HCV E2 polypeptide.

As another in some cases, a modified E1 polypeptide comprises, from N-terminus to C-terminus: a) an HCV E1 polypeptide; b) a flexible linker of from 1 to 10 amino acids; and c) LEVLFQ (SEQ ID NO:76), ENLYYFQ (SEQ ID NO:83), LVPR (SEQ ID NO:78), I(E/D)GR (SEQ ID NO:90), or DDDDK (SEQ ID NO:77).

As another in some cases, a modified E2 polypeptide comprises, from N-terminus to C-terminus: a) an HCV E2 polypeptide; b) a flexible linker of from 1 to 10 amino acids; and c) LEVLFQ (SEQ ID NO:76), ENLYYFQ (SEQ ID NO:83), LVPR (SEQ ID NO:78), I(E/D)GR (SEQ ID NO:90), or DDDDK (SEQ ID NO:77).

E2 with N-Terminal Heterologous Amino Acids

In some cases, an HCV E1/E2 heterodimer suitable for inclusion in an immunogenic composition of the present disclosure comprises a modified HCV E2 polypeptide with from 1 to 6 amino acids from the proteolytically cleavable linker on the N-terminus of the E2 polypeptide. In some cases, an HCV E1/E2 heterodimer suitable for inclusion in an immunogenic composition of the present disclosure comprises: a) an HCV E1 polypeptide; and b) a modified E2 polypeptide comprising, in order from N-terminus to C-terminus: i) from 1 to 6 heterologous amino acids wherein the from 1 to 6 heterologous amino acids are C-terminal to a site of proteolytic cleavage in a proteolytically cleavable linker; and ii) an HCV E2 polypeptide.

Proteolytically cleavable linkers are described elsewhere herein. Following proteolytic cleavage of a precursor polypeptide, as described herein, a modified E2 polypeptide is generated, which modified E2 polypeptide comprises, at its N-terminus, amino acids C-terminal to the protease cleavage site within the proteolytically cleavable linker.

For example, where the proteolytically cleavable linker comprises a PreScission cleavage site (LEVLFQGP; SEQ ID NO:65), where cleavage occurs between the glutamine and the glycine, a modified E2 polypeptide present in a heterodimeric E1/E2 polypeptide suitable for inclusion in an immunogenic composition of the present disclosure comprises, in order from N-terminus to C-terminus: a) Gly-Pro; and b) an HCV E2 polypeptide. As another example, where the proteolytically cleavable linker comprises a TEV cleavage site (ENLYFQS; SEQ ID NO:66), where cleavage occurs between the glutamine and the serine, a modified E2 polypeptide present in a heterodimeric E1/E2 polypeptide suitable for inclusion in an immunogenic composition of the present disclosure comprises, in order from N-terminus to C-terminus: a) Ser; and b) an HCV E2 polypeptide.

As another example, where the proteolytically cleavable linker comprises a TEV cleavage site (ENLYFQG; SEQ ID NO:67), where cleavage occurs between the glutamine and the glycine, a modified E2 polypeptide present in a heterodimeric E1/E2 polypeptide suitable for inclusion in an immunogenic composition of the present disclosure comprises, in order from N-terminus to C-terminus: a) Gly; and b) an HCV E2 polypeptide.

As another example, where the proteolytically cleavable linker comprises a thrombin cleavage site (LVPRGS; SEQ ID NO:68), where cleavage occurs between the arginine and the glycine, a modified E2 polypeptide present in a heterodimeric E1/E2 polypeptide suitable for inclusion in an immunogenic composition of the present disclosure comprises, in order from N-terminus to C-terminus: a) Gly-Ser; and an HCV E2 polypeptide.

As another example, where the proteolytically cleavable linker comprises a Factor Xa cleavage site (I(E/D)GRX, where X is any amino acid except arginine or proline; SEQ ID NO:69), where cleavage occurs between the arginine and the X, a modified E2 polypeptide present in a heterodimeric E1/E2 polypeptide suitable for inclusion in an immunogenic composition of the present disclosure comprises, in order from N-terminus to C-terminus: a) X (where X is any amino acid except arginine or proline); and an HCV E2 polypeptide.

Thus, for example, in some cases, an HCV E1/E2 heterodimer suitable for inclusion in an immunogenic composition of the present disclosure comprises: a) an HCV E1 polypeptide; and b) a modified E2 polypeptide comprising, in order from N-terminus to C-terminus: i) from 1 to 6 heterologous amino acids, wherein the from 1 to 6 (e.g., 1, 2, 3, 4, 5, or 6) heterologous amino acids are C-terminal to a site of proteolytic cleavage in a proteolytically cleavable linker; and ii) an HCV E2 polypeptide. In some cases, the 1 to 6 heterologous amino acids are Gly-Pro. In some cases, the 1 to 6 heterologous amino acids is Ser. In some cases, the 1 to 6 heterologous amino acids is Gly. In some cases, the 1 to 6 heterologous amino acids are Gly-Ser.

As another example, in some cases, an HCV E1/E2 heterodimer suitable for inclusion in an immunogenic composition of the present disclosure comprises: a) an HCV E2 polypeptide; and b) a modified E1 polypeptide comprising, in order from N-terminus to C-terminus: i) from 1 to 6 heterologous amino acids, wherein the from 1 to 6 (e.g., 1, 2, 3, 4, 5, or 6) heterologous amino acids are C-terminal to a site of proteolytic cleavage in a proteolytically cleavable linker; and ii) an HCV E1 polypeptide. In some cases, the 1 to 6 heterologous amino acids are Gly-Pro. In some cases, the 1 to 6 heterologous amino acids is Ser. In some cases, the 1 to 6 heterologous amino acids is Gly. In some cases, the 1 to 6 heterologous amino acids are Gly-Ser.

E1 with N-Terminal Heterologous Amino Acids

In some cases, an HCV E1/E2 heterodimer suitable for inclusion in an immunogenic composition of the present disclosure comprises a modified HCV E1 polypeptide with from 1 to 6 amino acids from a proteolytically cleavable linker on the N-terminus of the E1 polypeptide. In some cases, an HCV E1/E2 heterodimer suitable for inclusion in an immunogenic composition of the present disclosure comprises: a) an HCV E2 polypeptide; and b) a modified E1 polypeptide comprising, in order from N-terminus to C-terminus: i) from 1 to 6 heterologous amino acids wherein the from 1 to 6 heterologous amino acids are C-terminal to a site of proteolytic cleavage in a proteolytically cleavable linker; and ii) an HCV E1 polypeptide.

Proteolytically cleavable linkers are described elsewhere herein. Following proteolytic cleavage of a precursor polypeptide (e.g., a precursor polypeptide comprising, in order from N-terminus to C-terminus: a) an Fc polypeptide or an HCV E2 polypeptide; b) a proteolytically cleavable linker; and c) an HCV E1 polypeptide), a modified E1 polypeptide is generated, which modified E1 polypeptide comprises, at its N-terminus, amino acids C-terminal to the protease cleavage site within the proteolytically cleavable linker.

For example, where the proteolytically cleavable linker comprises a PreScission cleavage site (LEVLFQGP; SEQ ID NO:65), where cleavage occurs between the glutamine and the glycine, a modified E1 polypeptide present in an HCV E1/E2 heterodimer suitable for inclusion in an immunogenic composition of the present disclosure comprises, in order from N-terminus to C-terminus: a) Gly-Pro; and b) an HCV E1 polypeptide.

As another example, where the proteolytically cleavable linker comprises a TEV cleavage site (ENLYFQS; SEQ ID NO:66), where cleavage occurs between the glutamine and the serine, a modified E1 polypeptide present in an HCV E1/E2 heterodimer suitable for inclusion in an immunogenic composition of the present disclosure comprises, in order from N-terminus to C-terminus: a) Ser; and b) an HCV E1 polypeptide.

As another example, where the proteolytically cleavable linker comprises a TEV cleavage site (ENLYFQG; SEQ ID NO:67), where cleavage occurs between the glutamine and the glycine, a modified E1 polypeptide present in an HCV E1/E2 heterodimer suitable for inclusion in an immunogenic composition of the present disclosure comprises, in order from N-terminus to C-terminus: a) Gly; and b) an HCV E1 polypeptide.

As another example, where the proteolytically cleavable linker comprises a thrombin cleavage site (LVPRGS; SEQ ID NO:68), where cleavage occurs between the arginine and the glycine, a modified E1 polypeptide present in an HCV E1/E2 heterodimer suitable for inclusion in an immunogenic composition of the present disclosure comprises, in order from N-terminus to C-terminus: a) Gly-Ser; and an HCV E1 polypeptide.

As another example, where the proteolytically cleavable linker comprises a Factor Xa cleavage site (I(E/D)GRX, where X is any amino acid except arginine or proline; SEQ ID NO:69), where cleavage occurs between the arginine and the X, a modified E1 polypeptide present in an HCV E1/E2 heterodimer suitable for inclusion in an immunogenic composition of the present disclosure comprises, in order from N-terminus to C-terminus: a) X (where X is any amino acid except arginine or proline); and an HCV E1 polypeptide.

E2 with C-Terminal Heterologous Amino Acids

In some cases, an HCV E1/E2 heterodimer suitable for inclusion in an immunogenic composition of the present disclosure comprises a modified HCV E2 polypeptide with from 1 to 6 amino acids from a proteolytically cleavable linker on the C-terminus of the E2 polypeptide. In some cases, an HCV E1/E2 heterodimer suitable for inclusion in an immunogenic composition of the present disclosure comprises: a) an HCV E1 polypeptide; and b) a modified E2 polypeptide comprising, in order from N-terminus to C-terminus: i) an HCV E2 polypeptide; and ii) from 1 to 6 heterologous amino acids wherein the from 1 to 6 heterologous amino acids are N-terminal to a site of proteolytic cleavage in a proteolytically cleavable linker.

Proteolytically cleavable linkers are described elsewhere herein. Following proteolytic cleavage of a precursor polypeptide (e.g., a precursor polypeptide comprising, in order from N-terminus to C-terminus: a) HCV E2 polypeptide; b) a proteolytically cleavable linker; and c) an Fc polypeptide or an HCV E1 polypeptide), a modified E2 polypeptide is generated, which modified E2 polypeptide comprises, at its C-terminus, amino acids N-terminal to the protease cleavage site within the proteolytically cleavable linker.

For example, where the proteolytically cleavable linker comprises a PreScission cleavage site (LEVLFQGP; SEQ ID NO:65), where cleavage occurs between the glutamine and the glycine, a modified E2 polypeptide present in an HCV E1/E2 heterodimer suitable for inclusion in an immunogenic composition of the present disclosure comprises, in order from N-terminus to C-terminus: a) an HCV E2 polypeptide; and b) LEVLFQ (SEQ ID NO:76).

As another example, where the proteolytically cleavable linker comprises an enterokinase cleavage site (DDDDK; SEQ ID NO:77), where cleavage occurs C-terminal to the Lys, a modified E2 polypeptide present in an HCV E1/E2 heterodimer suitable for inclusion in an immunogenic composition of the present disclosure comprises, in order from N-terminus to C-terminus: a) an HCV E2 polypeptide; and b) DDDDK (SEQ ID NO:77).

As another example, where the proteolytically cleavable linker comprises a TEV cleavage site (ENLYFQG; SEQ ID NO:67), where cleavage occurs between the glutamine and the glycine, a modified E2 polypeptide present in an HCV E1/E2 heterodimer suitable for inclusion in an immunogenic composition of the present disclosure comprises, in order from N-terminus to C-terminus: a) an HCV E2 polypeptide; and b) ENLYFQ.

As another example, where the proteolytically cleavable linker comprises a thrombin cleavage site (LVPRGS; SEQ ID NO:68), where cleavage occurs between the arginine and the glycine, a modified E2 polypeptide present in an HCV E1/E2 heterodimer suitable for inclusion in an immunogenic composition of the present disclosure comprises, in order from N-terminus to C-terminus: a) an HCV E2 polypeptide; and LVPR (SEQ ID NO:78).

As another example, where the proteolytically cleavable linker comprises a Factor Xa cleavage site (I(E/D)GRX, where X is any amino acid except arginine or proline; SEQ ID NO:69), where cleavage occurs between the arginine and the X, a modified E2 polypeptide present in an HCV E1/E2 heterodimer suitable for inclusion in an immunogenic composition of the present disclosure comprises, in order from N-terminus to C-terminus: a) an HCV E2 polypeptide; and I(E/D)GR (SEQ ID NO:90).

E1 with C-Terminal Heterologous Amino Acids

In some cases, an HCV E1/E2 heterodimer suitable for inclusion in an immunogenic composition of the present disclosure comprises a modified HCV E1 polypeptide with from 1 to 6 amino acids from a proteolytically cleavable linker on the C-terminus of the E1 polypeptide. In some cases, an HCV E1/E2 heterodimer suitable for inclusion in an immunogenic composition of the present disclosure comprises: a) an HCV E2 polypeptide; and b) a modified E1 polypeptide comprising, in order from N-terminus to C-terminus: i) an HCV E1 polypeptide; and ii) from 1 to 6 heterologous amino acids wherein the from 1 to 6 heterologous amino acids are N-terminal to a site of proteolytic cleavage in a proteolytically cleavable linker.

Proteolytically cleavable linkers are described elsewhere herein. Following proteolytic cleavage of a precursor polypeptide (e.g., a precursor polypeptide comprising, in order from N-terminus to C-terminus: a) HCV E1 polypeptide; b) a proteolytically cleavable linker; and c) an Fc polypeptide or an HCV E2 polypeptide), a modified E1 polypeptide is generated, which modified E1 polypeptide comprises, at its C-terminus, amino acids N-terminal to the protease cleavage site within the proteolytically cleavable linker.

For example, where the proteolytically cleavable linker comprises a PreScission cleavage site (LEVLFQGP; SEQ ID NO:65), where cleavage occurs between the glutamine and the glycine, a modified E1 polypeptide present in an HCV E1/E2 heterodimer suitable for inclusion in an immunogenic composition of the present disclosure comprises, in order from N-terminus to C-terminus: a) an HCV E1 polypeptide; and b) LEVLFQ (SEQ ID NO:76).

As another example, where the proteolytically cleavable linker comprises an enterokinase cleavage site (DDDDK; SEQ ID NO:77), where cleavage occurs C-terminal to the Lys, a modified E1 polypeptide present in an HCV E1/E2 heterodimer suitable for inclusion in an immunogenic composition of the present disclosure comprises, in order from N-terminus to C-terminus: a) an HCV E1 polypeptide; and b) DDDDK (SEQ ID NO:77).

As another example, where the proteolytically cleavable linker comprises a TEV cleavage site (ENLYFQG; SEQ ID NO:67), where cleavage occurs between the glutamine and the glycine, a modified E1 polypeptide present in an HCV E1/E2 heterodimer suitable for inclusion in an immunogenic composition of the present disclosure comprises, in order from N-terminus to C-terminus: a) an HCV E1 polypeptide; and b) ENLYFQ.

As another example, where the proteolytically cleavable linker comprises a thrombin cleavage site (LVPRGS; SEQ ID NO:68), where cleavage occurs between the arginine and the glycine, a modified E1 polypeptide present in an HCV E1/E2 heterodimer suitable for inclusion in an immunogenic composition of the present disclosure comprises, in order from N-terminus to C-terminus: a) an HCV E1 polypeptide; and LVPR (SEQ ID NO:78).

As another example, where the proteolytically cleavable linker comprises a Factor Xa cleavage site (I(E/D)GRX, where X is any amino acid except arginine or proline; SEQ ID NO:69), where cleavage occurs between the arginine and the X, a modified E1 polypeptide present in an HCV E1/E2 heterodimer suitable for inclusion in an immunogenic composition of the present disclosure comprises, in order from N-terminus to C-terminus: a) an HCV E1 polypeptide; and I(E/D)GR (SEQ ID NO:90).

Additional Polypeptides

In any of the above-described embodiments, one or both of the polypeptide chains of the E1/E2 heterodimer can include one or more additional polypeptides. For example, the E1 polypeptide, the E2 polypeptide, or both the E1 and the E2 polypeptide, can include an affinity tag. Suitable affinity tags include, e.g., immunoglobulin Fc polypeptides, a poly(histidine) tag (e.g., $His_6$), a maltose binding protein (MBP), a glutathione-S-transferase (GST) polypeptide, calmodulin-binding peptide (CBP), Streptavidin-binding peptide (SBP), Strep-tag II, FLAG (e.g., DYKDDDDK (SEQ ID NO:91), hemagglutinin (HA) (e.g., YPYDVPDYA (SEQ ID NO:92), c-myc T7 ((e.g., EQKLISEEDL; SEQ ID NO:93), Glu-Glu, starch-binding domain (SBD), and Flag-Acidic-Target Tag (FATT), and the like.

In some cases, an E1/E2 heterodimer included in a composition of the present disclosure includes a variant E2 polypeptide. In some cases, the E1 polypeptide or the variant E2 polypeptide can include an Ig Fc polypeptide at the C-terminus of the E1 polypeptide or the variant E2 polypeptide. As another example, in some cases, the E1 polypeptide or the variant E2 polypeptide can include an Ig Fc polypeptide at the N-terminus of the E1 polypeptide or the variant E2 polypeptide. Ig Fc polypeptides are known in the art, and are described elsewhere herein.

Heterologous Polypeptides (T-Cell Epitope Polypeptides)

As noted above, in some cases, an immunogenic composition of the present disclosure comprises: a) an HCV E1/E2 heterodimer, or an HCV E1 polypeptide, or an HCV E2 polypeptide; and b) a heterologous polypeptide comprising a T-cell epitope present in an HCV protein other than E1 and E2. In some cases, an immunogenic composition of the present disclosure comprises an HCV E1/E2 heterodimer, and a heterologous polypeptide comprising a T-cell epitope present in an HCV protein other than E1 and E2. In other cases, an immunogenic composition of the present disclosure comprises an HCV E1 polypeptide, and a heterologous polypeptide comprising a T-cell epitope present in an HCV protein other than E1 and E2. In other cases, an immunogenic composition of the present disclosure comprises an HCV E2 polypeptide, and a heterologous polypeptide comprising a T-cell epitope present in an HCV protein other than E1 and E2. Heterologous polypeptides suitable for inclusion in an immunogenic polypeptide of the present disclosure comprise T cell epitopes that are conserved among different HCV genotypes leading to cross-reactive cellular immune responses. In some cases, the heterologous T-cell epitope polypeptide does not include a neotope; for example, in some cases, the heterologous T-cell epitope polypeptide does not include a junction formed by amino acid sequences that do not naturally occur adjacent to one another in a naturally-occurring HCV polypeptide.

In some cases, the heterologous polypeptide comprises 1, 2, 3, 4, 5, 6, 7, 8, 9, or 10, or more than 10 (e.g., from 10 to 15, from 15 to 20, from 20 to 25, or from 25 to 30, or more than 30), T cell epitopes. T-cell epitopes are epitopes that, when presented with a major histocompatibility complex (MHC) (e.g., a human leukocyte antigen (HLA)) Class I or MHC Class II molecule, are recognized and bound by a T-cell receptor (TCR) present on a T cell surface. T-cell epitopes include epitopes recognized by cytotoxic T cells (e.g., $CD8^+$ T cells), and epitopes recognized by helper T cells (e.g., $CD4^+$ T cells).

The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein. A suitable source of T-cell epitopes includes non-toxic mutants of toxins, where the mutants are referred to as "cross-reactive material (CRM)." Other examples of strong T helper epitopes are diphtheria toxoid, tetanus toxoid, meningococcal outer membrane protein, or mutant diphtheria protein CRM197 (see, e.g.: http://www(dot)medscape(dot)com/viewarticle/431127).

In some cases, the heterologous polypeptide comprises a single T-cell epitope. In some cases, the heterologous polypeptide comprises a single HCV-NS3 T-cell epitope. In some cases, the heterologous polypeptide comprises 2 or more T-cell epitopes. In some cases, the heterologous polypeptide comprises 2 or more HCV-NS3 T-cell epitopes. In some cases, the heterologous polypeptide comprises 3 or more HCV-NS3 T-cell epitopes. In some cases, the heterologous polypeptide comprises 4 or more HCV-NS3 T-cell epitopes. In some cases, the heterologous polypeptide comprises a single HCV-NS3 $CD4^+$ T-cell epitope. In some cases, the heterologous polypeptide comprises 2 or more HCV-NS3 $CD4^+$ T-cell epitopes. In some cases, the heterologous polypeptide comprises one or more HCV $CD8^+$ T cell epitopes. In some cases, the heterologous polypeptide comprises a single HCV-NS3 $CD8^+$ T-cell epitope. In some cases, the heterologous polypeptide comprises 2 or more HCV-NS3 $CD8^+$ T-cell epitopes. In some cases, the heterologous polypeptide comprises at least one HCV $CD4^+$ T cell epitope and at least one HCV $CD8^+$ T cell epitope. In some cases, the heterologous polypeptide comprises at least one HCV-NS3 $CD4^+$ T cell epitope and at least one HCV-NS3 $CD8^+$ T cell epitope. In some cases, heterologous polypeptide comprises 2 or more HCV-NS3 $CD4^+$ T-cell epitopes and 2 or more HCV-NS3 $CD8^+$ T-cell epitopes. In some cases, the heterologous polypeptide comprises 2, 3, 4, or 5 HCV-NS3 $CD4^+$ T-cell epitopes and 2, 3, 4, or 5 HCV-NS3 $CD8^+$ T-cell epitopes.

In some cases, the heterologous polypeptide comprises a single T-cell epitope. In some cases, the heterologous polypeptide comprises a single HCV-NS2 T-cell epitope. In some cases, the heterologous polypeptide comprises 2 or more T-cell epitopes. In some cases, the heterologous polypeptide comprises 2 or more HCV-NS2 T-cell epitopes. In some cases, the heterologous polypeptide comprises 3 or more HCV-NS2 T-cell epitopes. In some cases, the heterologous polypeptide comprises 4 or more HCV-NS2 T-cell epitopes. In some cases, the heterologous polypeptide comprises a single HCV-NS2 $CD4^+$ T-cell epitope. In some cases, the heterologous polypeptide comprises 2 or more HCV-NS2 $CD4^+$ T-cell epitopes. In some cases, the heterologous polypeptide comprises one or more HCV $CD8^+$ T cell epitopes. In some cases, the heterologous polypeptide comprises a single HCV-NS2 $CD8^+$ T-cell epitope. In some cases, the heterologous polypeptide comprises 2 or more HCV-NS2 $CD8^+$ T-cell epitopes. In some cases, the heterologous polypeptide comprises at least one HCV $CD4^+$ T cell epitope and at least one HCV $CD8^+$ T cell epitope. In some cases, the heterologous polypeptide comprises at least one HCV-NS2 $CD4^+$ T cell epitope and at least one HCV-NS2 $CD8^+$ T cell epitope. In some cases, heterologous polypeptide comprises 2 or more HCV-NS2 $CD4^+$ T-cell epitopes and 2 or more HCV-NS2 $CD8^+$ T-cell epitopes. In some cases, the heterologous polypeptide comprises 2, 3, 4, or 5 HCV-NS2 $CD4^+$ T-cell epitopes and 2, 3, 4, or 5 HCV-NS2 $CD8^+$ T-cell epitopes.

In some cases, the heterologous polypeptide comprises a single T-cell epitope. In some cases, the heterologous polypeptide comprises a single HCV-NS4A T-cell epitope. In some cases, the heterologous polypeptide comprises 2 or more T-cell epitopes. In some cases, the heterologous polypeptide comprises 2 or more HCV-NS4A T-cell epitopes. In some cases, the heterologous polypeptide comprises 3 or more HCV-NS4A T-cell epitopes. In some cases, the heterologous polypeptide comprises 4 or more HCV-NS4A T-cell epitopes. In some cases, the heterologous polypeptide comprises a single HCV-NS4A $CD4^+$ T-cell epitope. In some cases, the heterologous polypeptide comprises 2 or more HCV-NS4A $CD4^+$ T-cell epitopes. In some cases, the heterologous polypeptide comprises one or more HCV $CD8^+$ T cell epitopes. In some cases, the heterologous polypeptide comprises a single HCV-NS4A $CD8^+$ T-cell epitope. In some cases, the heterologous polypeptide comprises 2 or more HCV-NS4A $CD8^+$ T-cell epitopes. In some cases, the heterologous polypeptide comprises at least one HCV $CD4^+$ T cell epitope and at least one HCV $CD8^+$ T cell epitope. In some cases, the heterologous polypeptide comprises at least one HCV-NS4A $CD4^+$ T cell epitope and at least one HCV-NS4A $CD8^+$ T cell epitope. In some cases, heterologous polypeptide comprises 2 or more HCV-NS4A $CD4^+$ T-cell epitopes and 2 or more HCV-NS4A $CD8^+$ T-cell epitopes. In some cases, the heterologous polypeptide comprises 2, 3, 4, or 5 HCV-NS4A $CD4^+$ T-cell epitopes and 2, 3, 4, or 5 HCV-NS4A $CD8^+$ T-cell epitopes.

In some cases, the heterologous polypeptide comprises a single T-cell epitope. In some cases, the heterologous polypeptide comprises a single HCV-NS5A T-cell epitope. In some cases, the heterologous polypeptide comprises 2 or more T-cell epitopes. In some cases, the heterologous polypeptide comprises 2 or more HCV-NS5A T-cell epitopes. In some cases, the heterologous polypeptide comprises 3 or more HCV-NS5A T-cell epitopes. In some cases, the heterologous polypeptide comprises 4 or more HCV-NS5A T-cell epitopes. In some cases, the heterologous polypeptide comprises a single HCV-NS5A $CD4^+$ T-cell epitope. In some cases, the heterologous polypeptide comprises 2 or more HCV-NS5A $CD4^+$ T-cell epitopes. In some cases, the heterologous polypeptide comprises one or more HCV $CD8^+$ T cell epitopes. In some cases, the heterologous polypeptide comprises a single HCV-NS5A $CD8^+$ T-cell epitope. In some cases, the heterologous polypeptide comprises 2 or more HCV-NS5A $CD8^+$ T-cell epitopes. In some cases, the heterologous polypeptide comprises at least one HCV $CD4^+$ T cell epitope and at least one HCV $CD8^+$ T cell epitope. In some cases, the heterologous polypeptide comprises at least one HCV-NS5A $CD4^+$ T cell epitope and at least one HCV-NS5A $CD8^+$ T cell epitope. In some cases, heterologous polypeptide comprises 2 or more HCV-NS5A $CD4^+$ T-cell epitopes and 2 or more HCV-NS5A $CD8^+$ T-cell epitopes. In some cases, the heterologous polypeptide comprises 2, 3, 4, or 5 HCV-NS5A $CD4^+$ T-cell epitopes and 2, 3, 4, or 5 HCV-NS5A $CD8^+$ T-cell epitopes.

In some cases, the heterologous polypeptide comprises a single T-cell epitope. In some cases, the heterologous polypeptide comprises a single HCV-NS5B T-cell epitope. In some cases, the heterologous polypeptide comprises 2 or more T-cell epitopes. In some cases, the heterologous polypeptide comprises 2 or more HCV-NS5B T-cell epitopes. In some cases, the heterologous polypeptide comprises 3 or more HCV-NS5B T-cell epitopes. In some cases, the heterologous polypeptide comprises 4 or more HCV-NS5B T-cell epitopes. In some cases, the heterologous polypeptide comprises a single HCV-NS5B $CD4^+$ T-cell epitope. In some cases, the heterologous polypeptide comprises 2 or more HCV-NS5B $CD4^+$ T-cell epitopes. In some cases, the heterologous polypeptide comprises one or more HCV $CD8^+$ T cell epitopes. In some cases, the heterologous polypeptide comprises a single HCV-NS5B $CD8^+$ T-cell epitope. In some cases, the heterologous polypeptide comprises 2 or more HCV-NS5B $CD8^+$ T-cell epitopes. In some cases, the heterologous polypeptide comprises at least one HCV $CD4^+$ T cell epitope and at least one HCV $CD8^+$ T cell epitope. In some cases, the heterologous polypeptide comprises at least one HCV-NS5B $CD4^+$ T cell epitope and at least one HCV-NS5B $CD8^+$ T cell epitope. In some cases, heterologous polypeptide comprises 2 or more HCV-NS5B $CD4^+$ T-cell epitopes and 2 or more HCV-NS5B $CD8^+$ T-cell epitopes. In some cases, the heterologous polypeptide comprises 2, 3, 4, or 5 HCV-NS5B $CD4^+$ T-cell epitopes and 2, 3, 4, or 5 HCV-NS5B $CD8^+$ T-cell epitopes.

In some cases, the heterologous polypeptide comprises a single T-cell epitope. In some cases, the heterologous polypeptide comprises a single HCV-core T-cell epitope. In some cases, the heterologous polypeptide comprises 2 or more T-cell epitopes. In some cases, the heterologous polypeptide comprises 2 or more HCV-core T-cell epitopes. In some cases, the heterologous polypeptide comprises 3 or more HCV-core T-cell epitopes. In some cases, the heterologous polypeptide comprises 4 or more HCV-core T-cell epitopes.

In some cases, the heterologous polypeptide comprises a single HCV-core CD4$^+$ T-cell epitope. In some cases, the heterologous polypeptide comprises 2 or more HCV-core CD4$^+$ T-cell epitopes. In some cases, the heterologous polypeptide comprises one or more HCV CD8$^+$ T cell epitopes. In some cases, the heterologous polypeptide comprises a single HCV-core CD8$^+$ T-cell epitope. In some cases, the heterologous polypeptide comprises 2 or more HCV-core CD8$^+$ T-cell epitopes. In some cases, the heterologous polypeptide comprises at least one HCV CD4$^+$ T cell epitope and at least one HCV CD8$^+$ T cell epitope. In some cases, the heterologous polypeptide comprises at least one HCV-core CD4$^+$ T cell epitope and at least one HCV-core CD8$^+$ T cell epitope. In some cases, heterologous polypeptide comprises 2 or more HCV-core CD4$^+$ T-cell epitopes and 2 or more HCV-core CD8$^+$ T-cell epitopes. In some cases, the heterologous polypeptide comprises 2, 3, 4, or 5 HCV-core CD4$^+$ T-cell epitopes and 2, 3, 4, or 5 HCV-core CD8$^+$ T-cell epitopes.

In some cases, the heterologous polypeptide comprises a single T-cell epitope. In some cases, the heterologous polypeptide comprises a single HCV-p7 T-cell epitope. In some cases, the heterologous polypeptide comprises 2 or more T-cell epitopes. In some cases, the heterologous polypeptide comprises 2 or more HCV-p7 T-cell epitopes. In some cases, the heterologous polypeptide comprises 3 or more HCV-p7 T-cell epitopes. In some cases, the heterologous polypeptide comprises 4 or more HCV-p7 T-cell epitopes. In some cases, the heterologous polypeptide comprises a single HCV-p7 CD4$^+$ T-cell epitope. In some cases, the heterologous polypeptide comprises 2 or more HCV-core CD4$^+$ T-cell epitopes. In some cases, the heterologous polypeptide comprises one or more HCV CD8$^+$ T cell epitopes. In some cases, the heterologous polypeptide comprises a single HCV-p7 CD8$^+$ T-cell epitope. In some cases, the heterologous polypeptide comprises 2 or more HCV-p7 CD8$^+$ T-cell epitopes. In some cases, the heterologous polypeptide comprises at least one HCV CD4$^+$ T cell epitope and at least one HCV CD8$^+$ T cell epitope. In some cases, the heterologous polypeptide comprises at least one HCV-p7 CD4$^+$ T cell epitope and at least one HCV-p7 CD8$^+$ T cell epitope. In some cases, heterologous polypeptide comprises 2 or more HCV-p7 CD4$^+$ T-cell epitopes and 2 or more HCV-p7 CD8$^+$ T-cell epitopes. In some cases, the heterologous polypeptide comprises 2, 3, 4, or 5 HCV-p7 CD4$^+$ T-cell epitopes and 2, 3, 4, or 5 HCV-p7 CD8$^+$ T-cell epitopes.

In some cases, the heterologous polypeptide comprises 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, or 63, of the T-cell epitopes set out in FIG. 9A-9B. In some cases, the heterologous polypeptide comprises from 1 to 3, from 3 to 5, from 5 to 10, from 10 to 15, from 15 to 20, from 20 to 25, or from 25 to 30 of the T-cell epitopes set out in FIG. 9A-9B. For example, in some cases, the heterologous polypeptide comprises the T-cell epitopes designated NS3-3, NS3-4, and NS3-11 in FIG. 9A-9B and FIG. 11A-11N. As another example, in some cases, the heterologous polypeptide comprises the T-cell epitopes designated NS2-1, NS2-2, NS2-3, NS2-7, and NS2-8 in FIG. 9A-9B and FIG. 11A-11N. As another example, in some cases, the heterologous polypeptide comprises the T-cell epitopes designated NS3-3, NS3-4, NS3-5, and NS3-11 in FIG. 9A-9B and FIG. 11A-11N. As another example, in some cases, the heterologous polypeptide comprises the T-cell epitopes designated NS3-3, NS3-4, NS3-5, NS3-6, NS3-7, NS3-11, NS3-12, and NS3-13 in FIG. 9A-9B and FIG. 11A-11N. As another example, in some cases, the heterologous polypeptide comprises the T-cell epitopes designated NS3-3, NS3-4, NS3-5, NS3-6, NS3-7, NS3-10, NS3-11, NS3-12, and NS3-13 in FIG. 9A-9B and FIG. 11A-11N. As another example, in some cases, the heterologous polypeptide comprises the T-cell epitopes designated Core-1, Core-2, Core-3, Core-4, Core-5, Core-6, Core-7, Core-8, Core-9, Core-10, Core-11, Core-12, Core-13, Core-14, Core-16, Core-17, Core-18, Core-19, Core-20, Core-21, and Core-22 in FIG. 9A-9B and FIG. 11A-11N. As another example, in some cases, the heterologous polypeptide comprises the T-cell epitopes designated NS3-1, NS3-2, NS3-3, NS3-4, NS3-5, NS3-6, NS3-7, NS3-9, NS3-10, NS3-11, NS3-12, and NS3-13 in FIG. 9A-9B and FIG. 11A-11N. As another example, in some cases, the heterologous polypeptide comprises the T-cell epitopes designated NS2-1, NS2-2, NS2-3, NS2-4, NS2-5, NS2-6, NS2-7, NS2-8, NS3-1, NS3-2, NS3-3, NS3-4, NS3-5, NS3-6, NS3-7, NS3-9, NS3-10, NS3-11, NS3-12, and NS3-13 in FIG. 9A-9B and FIG. 11A-11N. As another example, in some cases, the heterologous polypeptide comprises the T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, and NS4b-10 in FIG. 9A-9B and FIG. 11A-11N. As another example, in some cases, the heterologous polypeptide comprises the T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10, NS5a-1, NS5a-2, NS5b-1, and NS5b-2 in FIG. 9A-9B and FIG. 11A-11N. In some cases, the T-cell epitopes are contiguous. In some cases, any two T-cell epitopes are separated by linkers (e.g., a linker having a length of from 1 amino acid to about 50 amino acids, e.g., from 1 amino acid to 5 amino acids (aa), from 5 aa to 10 aa, from 10 aa to 15 aa, from 15 aa to 20 aa, from 20 aa to 25 aa, from 25 aa to 30 aa, from 30 aa to 40 aa, or from 40 aa to 50 aa).

In some cases, the heterologous polypeptide comprises at least one HCV CD4$^+$ T cell epitope and at least one HCV CD8$^+$ T cell epitope, where epitopes are conserved among HCV genotypes 1 and 2. In some cases, the heterologous polypeptide comprises at least one HCV CD4$^+$ T cell epitope and at least one HCV CD8$^+$ T cell epitope, where epitopes are conserved among HCV genotypes 1 and 3. In some cases, the heterologous polypeptide comprises at least one HCV CD4$^+$ T cell epitope and at least one HCV CD8$^+$ T cell epitope, where epitopes are conserved among HCV genotypes 1, 2, and 3. In some cases, the heterologous polypeptide comprises at least one HCV CD4$^+$ T cell epitope and at least one HCV CD8$^+$ T cell epitope, where epitopes are conserved among HCV genotypes 1, 2, 3, and 7. In some cases, the heterologous polypeptide comprises at least one HCV CD4$^+$ T cell epitope and at least one HCV CD8$^+$ T cell epitope, where epitopes are conserved among HCV genotypes 1-7.

The heterologous polypeptide can have a length of from about 10 amino acids to about 2000 amino acids; e.g., the heterologous polypeptide can have a length of from 10 amino acids (aa) to 15 aa, from 15 aa to 20 aa, from 20 aa to 25 aa, from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The heterologous polypeptide can have a length of from about 25 amino acids to about 2000 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 500 aa, from 500 aa to 600 aa, from 600 aa to 700 aa, from 700 aa to 800 aa, from 800 aa to 900 aa, from 900 aa to 1000 aa, from 1000 aa to 1100 aa, from 1100 aa to 1200 aa, from 1200 aa to 1300 aa, from 1300 aa to 1400 aa, from 1400 aa to 1500 aa, from 1500 aa to 1600 aa, from 1600 aa to 1700 aa, from 1700 aa to 1800 aa, from 1800 aa to 1900 aa, or from 1900 aa to 2000 aa. The heterologous polypeptide can have a length of from about 25 amino acids to about 3000 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 500 aa, from 500 aa to 600 aa, from 600 aa to 700 aa, from 700 aa to 800 aa, from 800 aa to 900 aa, from 900 aa to 1000 aa, from 1000 aa to 1100 aa, from 1100 aa to 1200 aa, from 1200 aa to 1300 aa, from 1300 aa to 1400 aa, from 1400 aa to 1500 aa, from 1500 aa to 1600 aa, from 1600 aa to 1700 aa, from 1700 aa to 1800 aa, from 1800 aa to 1900 aa, from 1900 aa to 2000 aa, from 2000 aa to 2250 aa, from 2250 aa to 2500 aa, from 2500 aa to 2750 aa, or from 2750 aa to 3000 aa.

The heterologous polypeptide can have a length of from about 25 amino acids to about 800 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The heterologous polypeptide can have a length of from about 25 amino acids to about 400 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, or from 350 aa to 400 aa. The heterologous polypeptide can have a length of 25 amino acids (aa), 26 aa, 27 aa, 28 aa, 29 aa, 30 aa, 31 aa, 32 aa, 33 aa, 34 aa, 35 aa, 36 aa, 37 aa, 38 aa, 39 aa, 40 aa, 41 aa, 42 aa, 43 aa, 44 aa, 45 aa, 46 aa, 47 aa, 48 aa, 49 aa, or 50 aa. The heterologous polypeptide can have a length of from about 100 amino acids (aa) to 800 aa, e.g., from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The heterologous polypeptide can have a length of from 25 aa to 30 aa. The heterologous polypeptide can have a length of from 30 aa to 40 aa. The heterologous polypeptide can have a length of from 40 aa to 50 aa. The heterologous polypeptide can have a length of from 50 aa to 60 aa (e.g., 50 aa, 51 aa, 52, aa, 53 aa, 54 aa, 55 aa, 56 aa, 57 aa, 58 aa, 59 aa, or 60 aa). The heterologous polypeptide can have a length of from 60 aa to 70 aa. The heterologous polypeptide can have a length of from 65 aa to 75 aa (e.g., 65, 66, 67, 68, 69, 70, 71, 72, 7, 74, or 75 aa). The heterologous polypeptide can have a length of 70 aa. The heterologous polypeptide can have a length of from 70 aa to 80 aa. The heterologous polypeptide can have a length of from 80 aa to 90 aa. The heterologous polypeptide can have a length of from 90 aa to 100 aa. The heterologous polypeptide can have a length of from 100 aa to 105 aa (e.g., 100, 101, 102, 103, 104, 105, 106, 107, 108, 109, or 110 aa). The heterologous polypeptide can have a length of 100 aa. The heterologous polypeptide can have a length of from 10 amino acids (aa) to 50 aa; e.g., from 10 aa to 15 aa, from 15 aa to 20 aa, from 20 aa to 25 aa, from 25 aa to 30 aa, from 30 aa to 35 aa, from 35 aa to 40 aa, from 40 aa to 45 aa, or from 45 aa to 50 aa. The heterologous polypeptide can have a length of from 10 amino acids (aa) to 20 aa, e.g., 10, 11, 12, 13, 14, 15, 16, 17, 18, 19, or 20 aa.

HCV NS3 T-Cell Epitopes

In some cases, the heterologous polypeptide present in an immunogenic composition of the present disclosure includes one or more T-cell epitopes present in an HCV NS3 polypeptide. Examples of T-cell epitopes present in NS3 polypeptides are depicted in FIG. 11A-11N, FIG. 9B, and FIG. 10A-10B.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKL (SEQ ID NO:94). AIPLEVIKGGRHLIFCHSKKKCDELAAKL (SEQ ID NO:94) is referred to in FIG. 10A as "TP29." In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKL (SEQ ID NO:94); and has a length of from 25 aa to 35 aa (e.g., 25 aa, 26 aa, 27 aa, 28 aa, 29 aa, 30 aa, 31 aa, 32 aa, 33 aa, 34 aa, or 35 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKG-GRHLIFCHSKKKCDELAAKL (SEQ ID NO:94); and has a length of 29 amino acids. Such a polypeptide can include NS3 T-cell epitopes designated NS3-3, NS3-4, and NS3-11 in FIG. 9B and FIG. 11A-11N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKLVALGI-NAVAYYRGLDVSVIPTSG (SEQ ID NO:95). AIPLEV-IKGGRHLIFCHSKKKCDELAAKLVALGINAVAYYR-GLDVSVIPTSG (SEQ ID NO:95) is referred to in FIG. 10A as "TP52." In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHS-KKKCDELAAKLVALGINAVAYYRGLDVSVIPTSG (SEQ ID NO:95); and has a length of from 45 amino acids to 60 amino acids (e.g., 45 aa, 46 aa, 47 aa, 48 aa, 49 aa, 50 aa, 51 aa, 52 aa, 53 aa, 54 aa, 55 aa, 56 aa, 57 aa, 58 aa, 59 aa, or 60 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHS-KKKCDELAAKLVALGINAVAYYRGLDVSVIPTSG (SEQ ID NO:95); and has a length of 52 amino acids. Such a polypeptide can include NS3 T-cell epitopes designated NS3-3, NS3-4, NS3-5, and NS3-11 in FIG. 9B and FIG. 11A-11N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: KGGRHLIFCHSKKKCDELAAKLVALGINAVAYYR-GLDVSVIPTSGDVVVVATDALMTG FTGDFDSVIDCN (SEQ ID NO:96); and has a length of from 65 amino acids to 80 amino acids (e.g., 65 aa, 66 aa, 67 aa, 68 aa, 69 aa, 70 aa, 71 aa, 72 aa, 73 aa, 74 aa, 75 aa, 76 aa, 77 aa, 78 aa, 79 aa, or 80 aa). KGGRHLIFCHSKKKCDELAAKLVALGI-NAVAYYRGLDVSVIPTSGDVVVVATDALMTG FTGDFDSVIDCN (SEQ ID NO:96) is referred to in FIG. 10A as "TP70."

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: KGGRHLIFCHSKKKCDELAAKLVALGI-NAVAYYRGLDVSVIPTSGDVVVVATDALMTG FTGDFDSVIDCN (SEQ ID NO:96); and has a length of 70 amino acids. Such a polypeptide can include NS3 T-cell epitopes designated NS3-3, NS3-4, NS3-5, NS3-6, NS3-7, NS3-11, NS3-12, and NS3-13 in FIG. 9B and FIG. 11A-11N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: VALSTTGEIPFYGKAIPLEVIKGGRHLIFCHS-KKKCDELAAKLVALGINAVAYYRGLDVS VIPTSGDVVV-VATDALMTGFTGDFDSVIDCNTCVTQTVDF (SEQ ID NO:97); and has a length of from 95 amino acids (aa) to 105 aa (e.g., 95 aa, 96 aa, 97 aa, 98 aa, 99 aa, 100 aa, 101 aa, 102 aa, 103 aa, 104 aa, or 105 aa). VALSTTGEIPFYGKAIPLE-VIKGGRHLIFCHSKKKCDELAAKLVALGINAVAYYR-GLDVS VIPTSGDVVV-VATDALMTGFTGDFDSVIDCNTCVTQTVDF (SEQ ID NO:97) is referred to in FIG. 10A as "TP100."

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: VALSTTGEIPFYGKAIPLEVIKGGRHLIFCHS-KKKCDELAAKLVALGINAVAYYRGLDVS VIPTSGDVVV-VATDALMTGFTGDFDSVIDCNTCVTQTVDF (SEQ ID NO:97); and has a length of 100 amino acids. Such a polypeptide can include NS3 T-cell epitopes designated NS3-3, NS3-4, NS3-5, NS3-6, NS3-7, NS3-10, NS3-11, NS3-12, and NS3-13 in FIG. 9B and FIG. 11A-11N.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQI-VGGVYLLPRRGPRLGVRATRKTSERSQP RGRRQPIPKARRPEGRTWAQPGYPWPLYGNEGCG-WAGWLLSPRGSRPSWGPTDPRRRS RNLGKVIDTLTCGFADLMGYIPLVGAPLGGAARAL-AHGVRVLEDGVNYATGNLPG (SEQ ID NO:89); and has a length of from 171 amino acids (aa) to 180 aa (e.g., 171 aa, 172 aa, 173 aa, 174 aa, 175 aa, 176 aa, 177 aa, 178 aa, 179 aa, or 180 aa. MSTNPKPQRKTKRN-TNRRPQDVKFPGGGQIVGGVYLL-PRRGPRLGVRATRKTSERSQP RGRRQPIPKARRPE-GRTWAQPGYPWPLYGNEGCGWAGWLLSPRGSRPS WGPTDPRRRS RNLGKVIDTLTCGFADLMGYIPLVGAPLGGAARAL-AHGVRVLEDGVNYATGNLPG (SEQ ID NO:89) is referred to in FIG. 10A as "TP171."

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRN-TNRRPQDVKFPGGGQIVGGVYLL-PRRGPRLGVRATRKTSERSQP RGRRQPIPKARRPE-GRTWAQPGYPWPLYGNEGCGWAGWLLSPRGSRPS WGPTDPRRRS RNLGKVIDTLTCGFADLMGYIPLVGAPLGGAARAL-AHGVRVLEDGVNYATGNLPG (SEQ ID NO:89); and has a length of 171 amino acids.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQI-VGGVYLLPRRGPRLGVRATRKTSERSQP RGRRQPIPKARRPEGRTWAQPGYPWPLYGNEGCG-WAGWLLSPRGSRPSWGPTDPRRRS RNLGKVIDTLTCGFADLMGYIPLVGAPLGGAARAL-AHGVRVLEDGVNYATGNLPGCSF SIFL-LALLSCLTVPASA (SEQ ID NO:98); and has a length of from 190 amino acids (aa) to 200 aa (e.g., 190 aa, 191 aa, 192 aa, 193 aa, 194 aa, 195 aa, 196 aa, 197 aa, 198 aa, 199 aa, or 200 aa.

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRN-TNRRPQDVKFPGGGQIVGGVYLL-PRRGPRLGVRATRKTSERSQP RGRRQPIPKARRPE-GRTWAQPGYPWPLYGNEGCGWAGWLLSPRGSRPS WGPTDPRRRS RNLGKVIDTLTCGFADLMGYIPLVGAPLGGAARAL-AHGVRVLEDGVNYATGNLPGCSF SIFL-LALLSCLTVPASA (SEQ ID NO:98); and has a length of 191 amino acids.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGSGK-STKVPAAYAAQGYKVLVLNPSVAATLGF-GAYMSKAHGIDPNIRTGVRTIT TGSPITYSTYGK-FLADGGCSGGAYDIIICDECHSTDATSILGIGTVLDQ AETAGARLVVLA TATPPGSVTVPHPNIEEVALSTT-GEIPFYGKAIPLEVIKGGRHLIFCHSKKKCDE-LAAKLV ALGINAVAYYRGLDVSVIPTSGDVVV-VATDALMTGFTGDFDSVIDCN (SEQ ID NO:81); and has a length of from 215 amino acids (aa) to 235 aa (e.g., 215 aa, 216 aa, 217 11, 218 aa, 219 aa, 220 aa, 221 aa, 222 aa, 223 aa, 224 aa, 225 aa, 226 aa, 227 aa, 228 aa, 229 aa, 230 aa, 231 aa, 232 aa, 233 aa, 234 aa, or 235 aa). LHAP-TGSGKSTKVPAAYAAQGYKVLVLNPSVAATLGF-GAYMSKAHGIDPNIRTGVRTIT TGSPITYSTYGK-FLADGGCSGGAYDIIICDECHSTDATSILGIGTVLDQA ETAGARLVVLA TATPPGSVTVPHPNIEEVALSTT-GEIPFYGKAIPLEVIKGGRHLIFCHSKKKCDE-LAAKLV ALGINAVAYYRGLDVSVIPTSGDVVV-VATDALMTGFTGDFDSVIDCN (SEQ ID NO:81) is referred to in FIG. 10A as "TP228."

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGSGK-STKVPAAYAAQGYKVLVLNPSVAATLGF-GAYMSKAHGIDPNIRTGVRTIT TGSPITYSTYGK-FLADGGCSGGAYDIIICDECHSTDATSILGIGTVLDQ AETAGARLVVLA TATPPGSVTVPHPNIEEVALSTT-GEIPFYGKAIPLEVIKGGRHLIFCHSKKKCDE-LAAKLV ALGINAVAYYRGLDVSVIPTSGDVVV-VATDALMTGFTGDFDSVIDCN (SEQ ID NO:81);

and has a length of 228 amino acids. Such a polypeptide can include NS3 T-cell epitopes designated NS3-1, NS3-2, NS3-3, NS3-4, NS3-5, NS3-6, NS3-7, NS3-9, NS3-10, NS3-11, NS3-12, and NS3-13 in FIG. 9B and FIG. 11A-11N.

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1265-1279 of the amino acid sequence designated "Consensus" in FIG. 12A-12L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1309-1323 of the amino acid sequence designated "Consensus" in FIG. 12A-12L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1401-1415 of the amino acid sequence designated "Consensus" in FIG. 12A-12L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1402-1412 of the amino acid sequence designated "Consensus" in FIG. 12A-12L, or a corresponding HCV NS3 amino acid sequence of any HCV genotype; and the HCV NS3 T-cell epitope can have a length of from 11 amino acids (aa) to 16 amino acids (e.g., 11 aa, 12 aa, 13 aa, 14 aa, 15 aa, or 16 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1429-1439 of the amino acid sequence designated "Consensus" in FIG. 12A-12L, or a corresponding HCV NS3 amino acid sequence of any HCV genotype; and the HCV NS3 T-cell epitope can have a length of from 11 amino acids (aa) to 16 amino acids (e.g., 11 aa, 12 aa, 13 aa, 14 aa, 15 aa, or 16 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1450-1464 of the amino acid sequence designated "Consensus" in FIG. 12A-12L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1453-1467 of the amino acid sequence designated "Consensus" in FIG. 12A-12L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1577-1591 of the amino acid sequence designated "Consensus" in FIG. 12A-12L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1306-1314 of the amino acid sequence designated "Consensus" in FIG. 12A-12L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1387-1394 of the amino acid sequence designated "Consensus" in FIG. 12A-12L, or a corresponding HCV NS3 amino acid sequence of any HCV genotype; and the HCV NS3 T-cell epitope can have a length of from 1 amino acids (aa) to 15 amino acids (e.g., 8 aa, 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1405-1413 of the amino acid sequence designated "Consensus" in FIG. 12A-12L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1450-1458 of the amino acid sequence designated "Consensus" in FIG. 12A-12L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1457-1465 of the amino acid sequence designated "Consensus" in FIG. 12A-12L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1610-1618 of the amino acid sequence designated "Consensus" in FIG. 12A-12L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

HCV NS2 T-Cell Epitopes

Figure 11A:
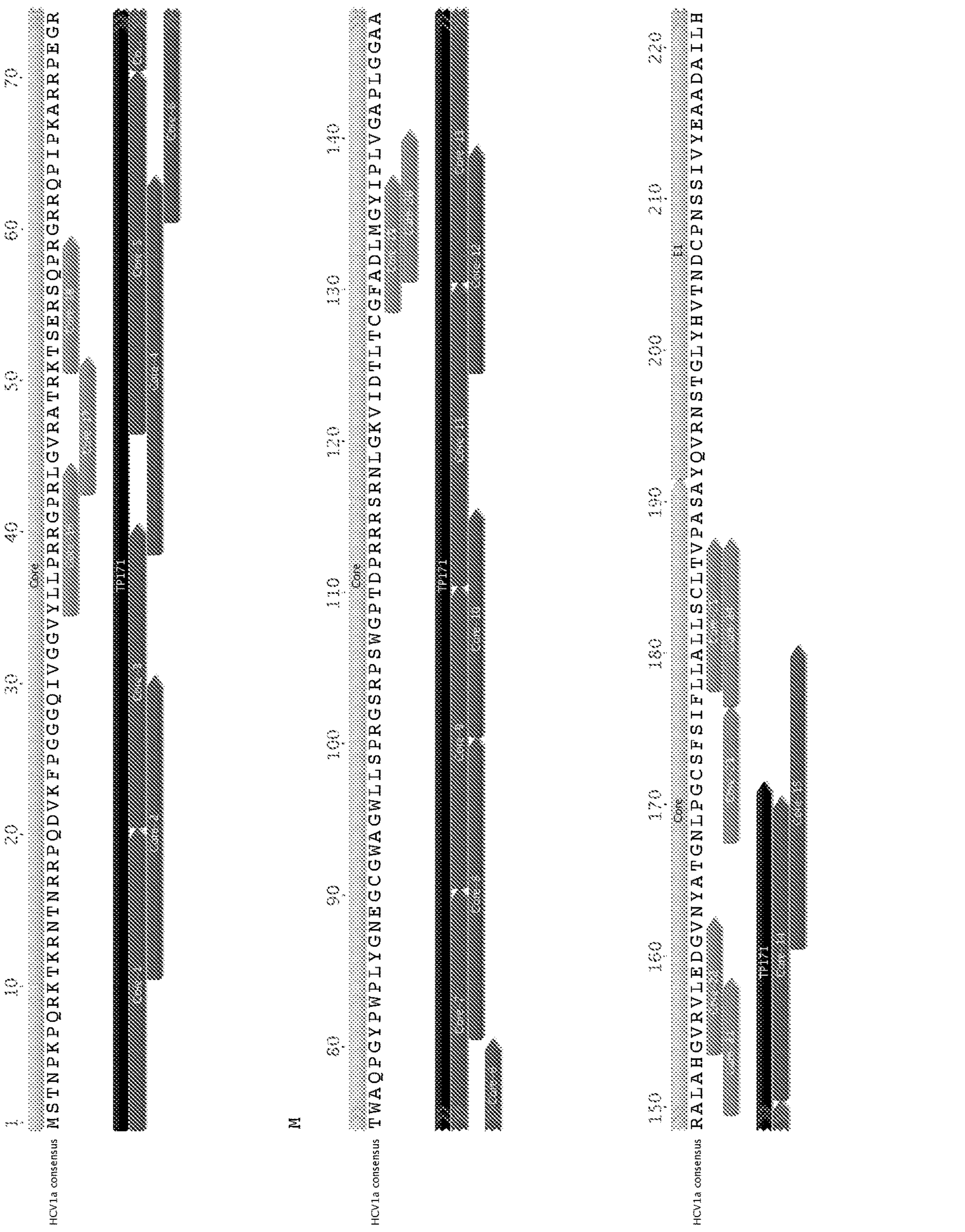
FIG. 11A-11N provide consensus amino acid sequences of HCV polypeptides; and depict the locations of T-cell epitopes (SEQ ID NO:169).
Figure 11D:
Figure 11E:
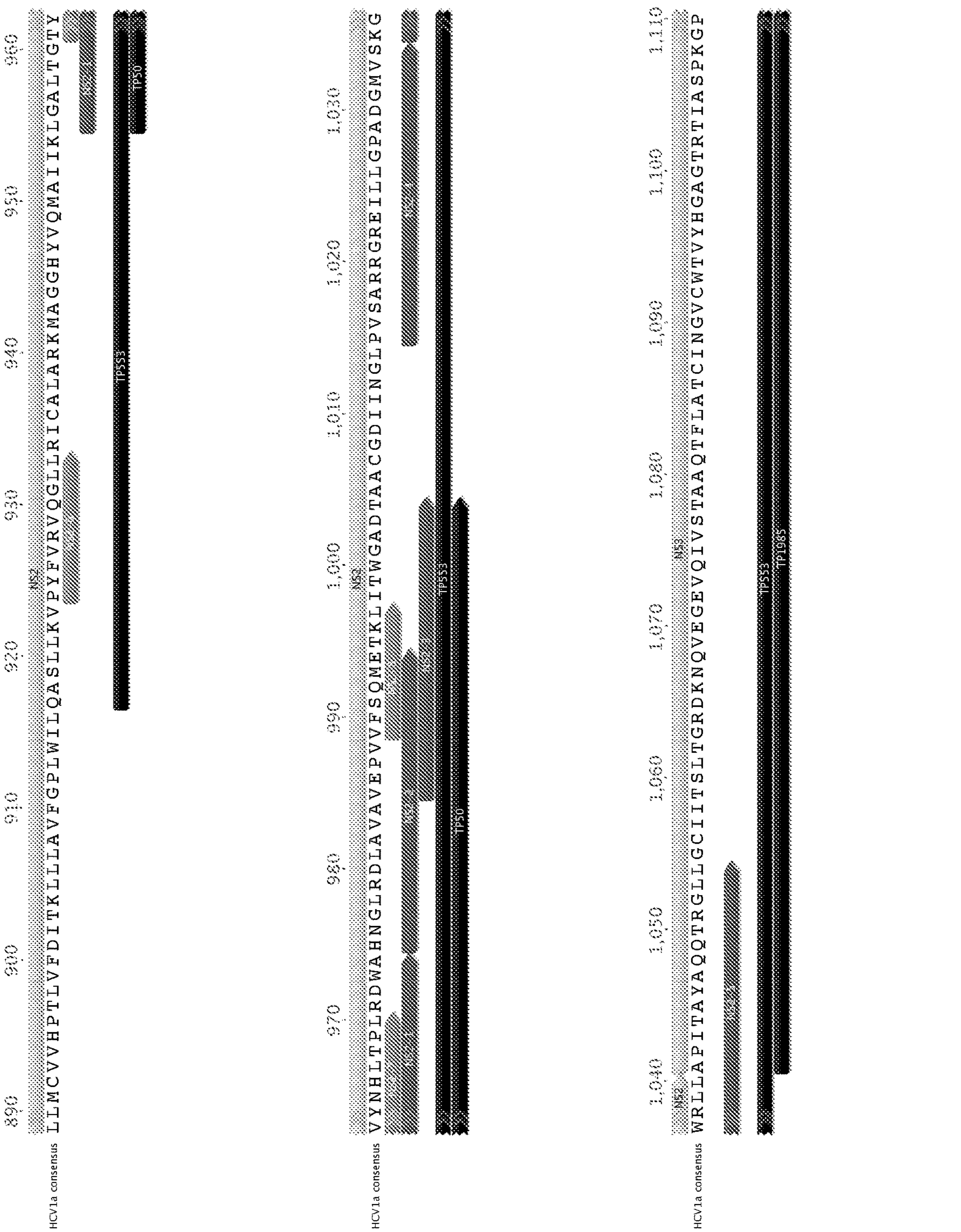
Figure 11F:
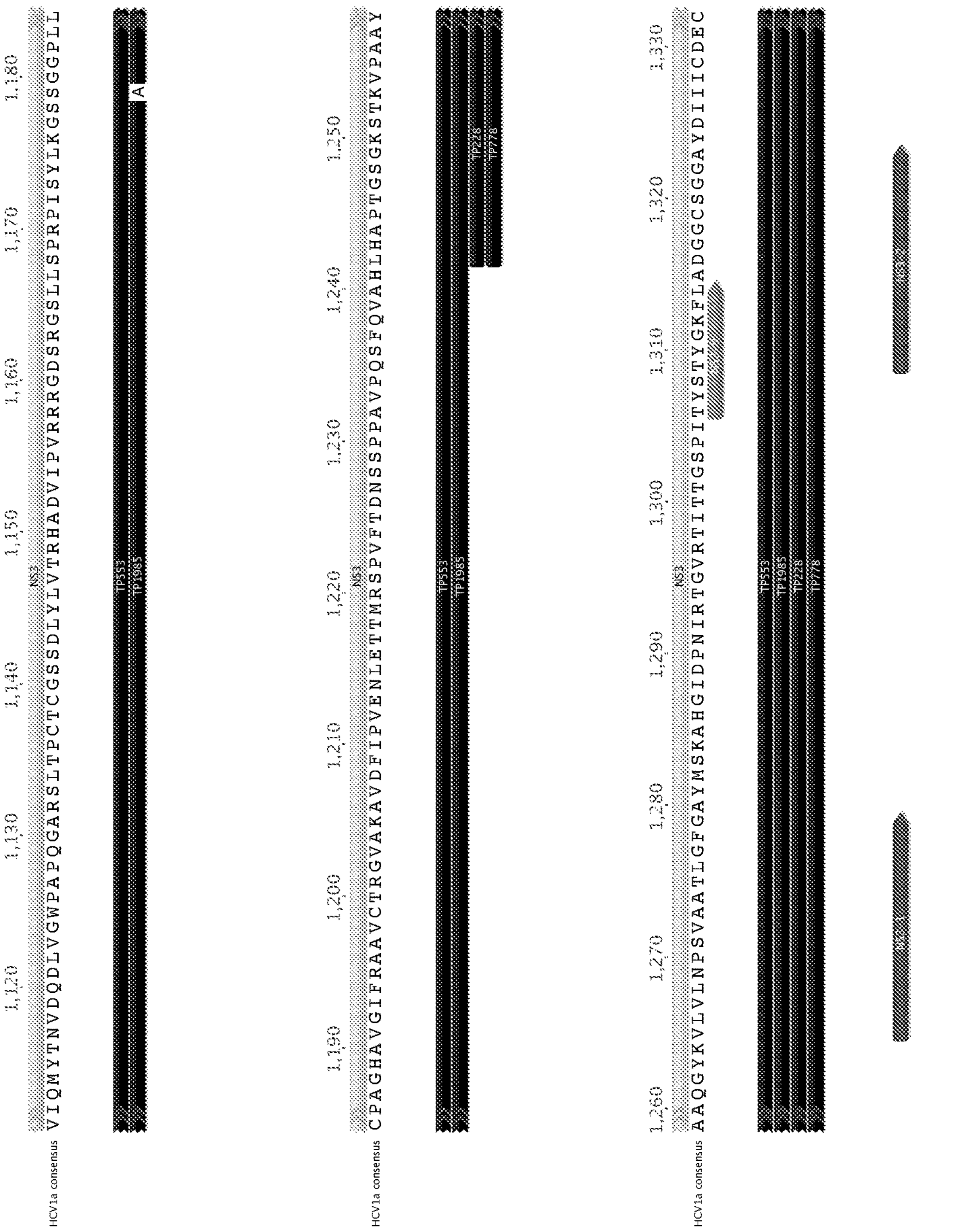
Figure 11G:
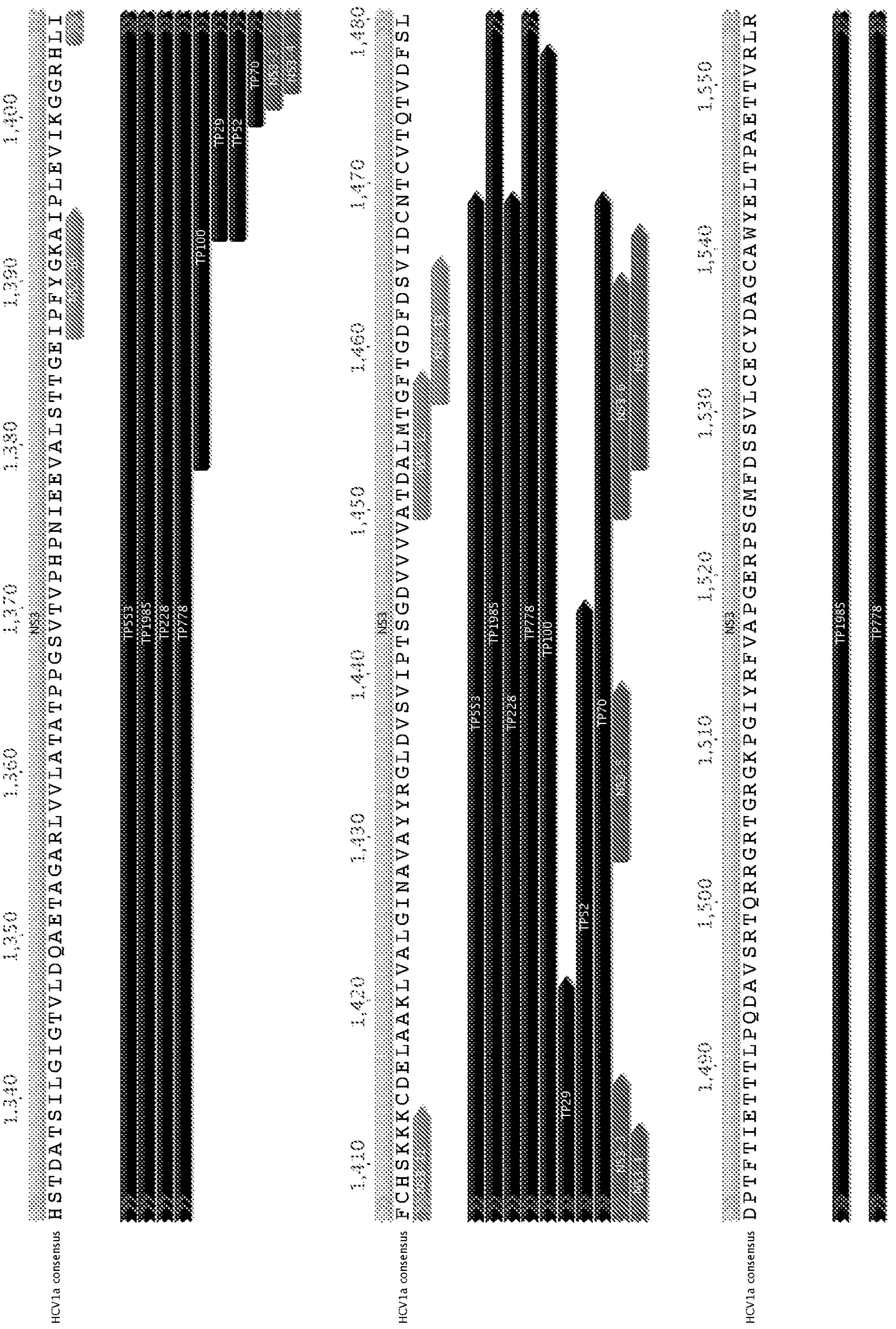
Figure 11H:
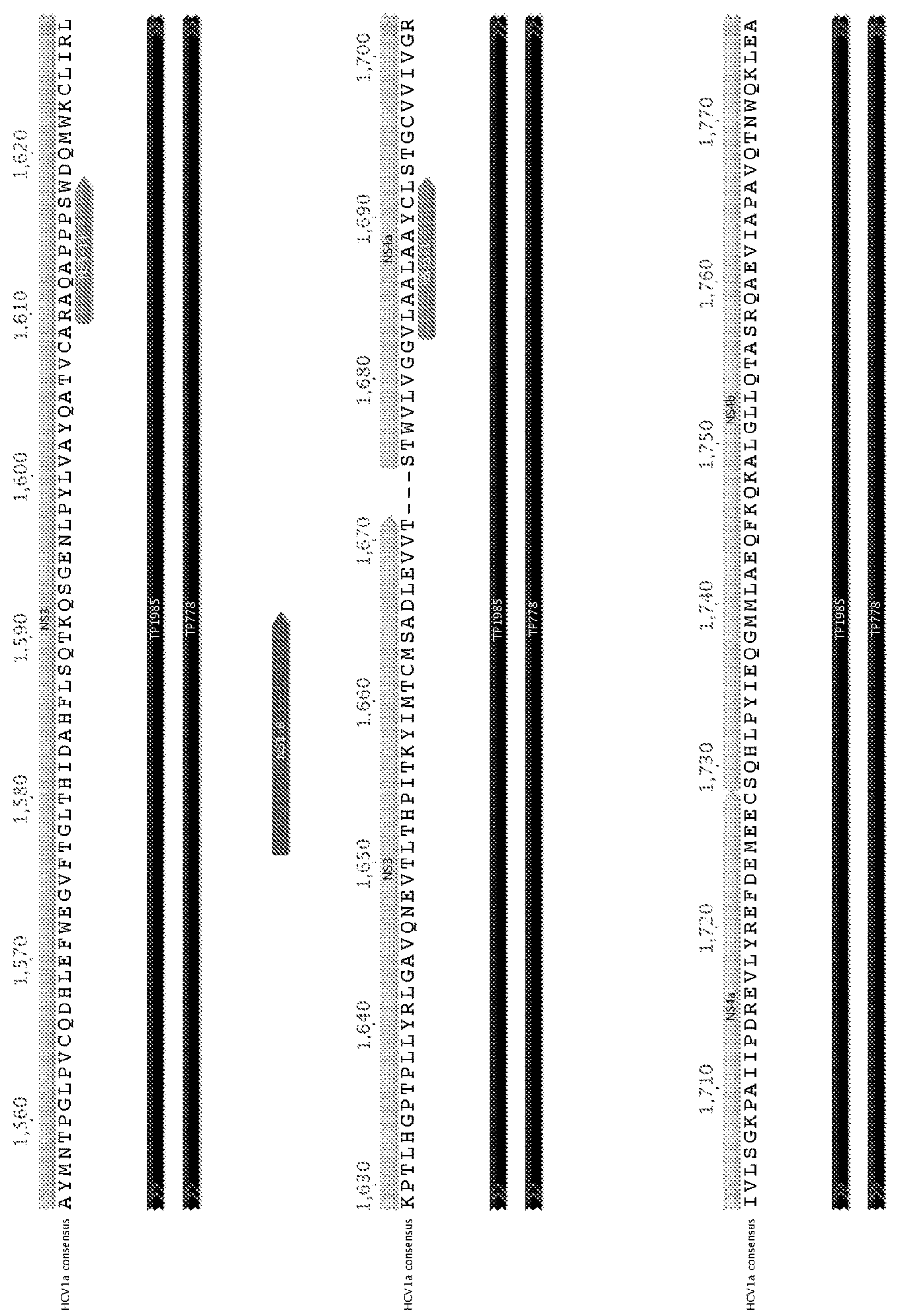
Figure 11I:
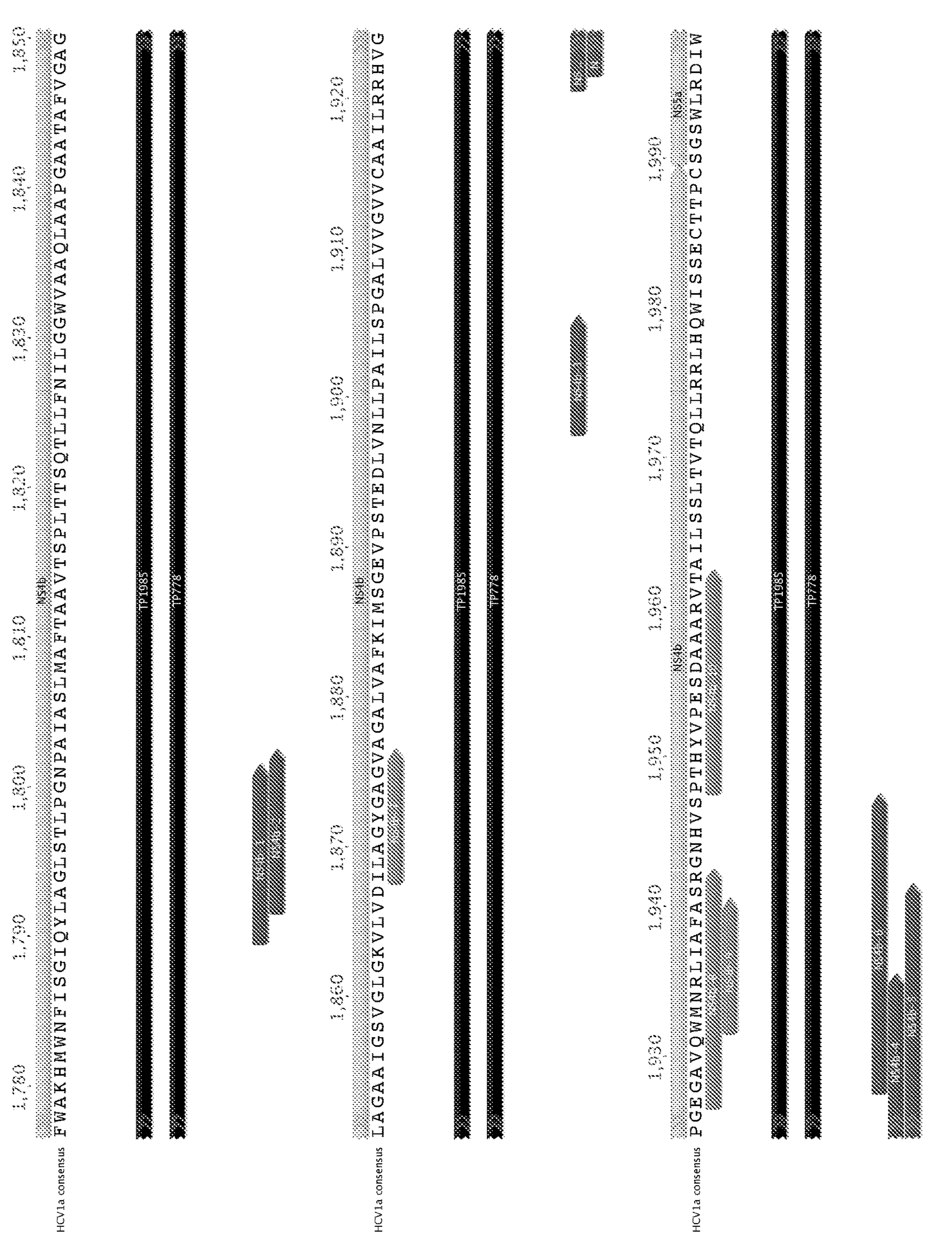
Figure 11J:
Figure 11K:
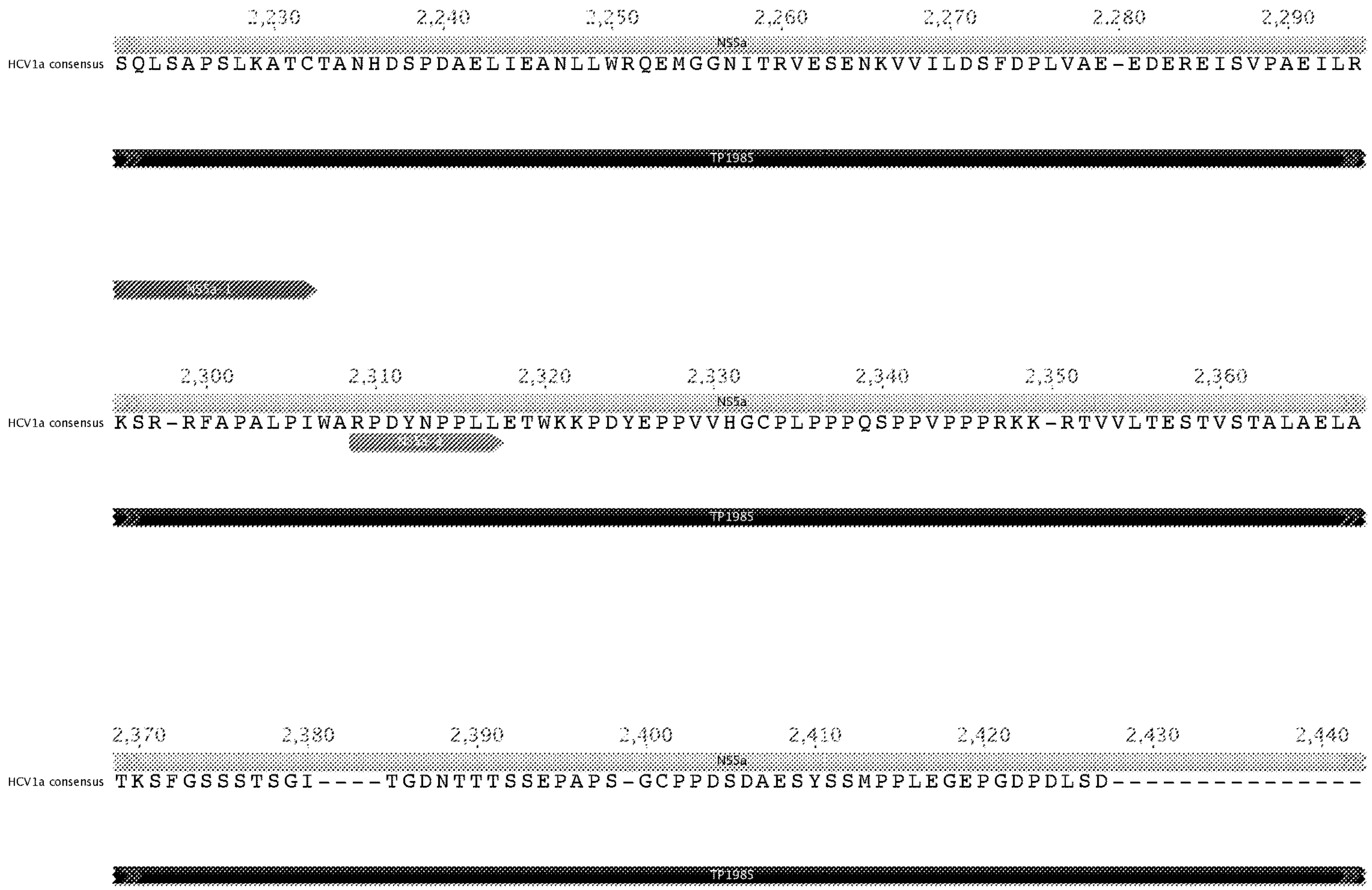
Figure 11L:
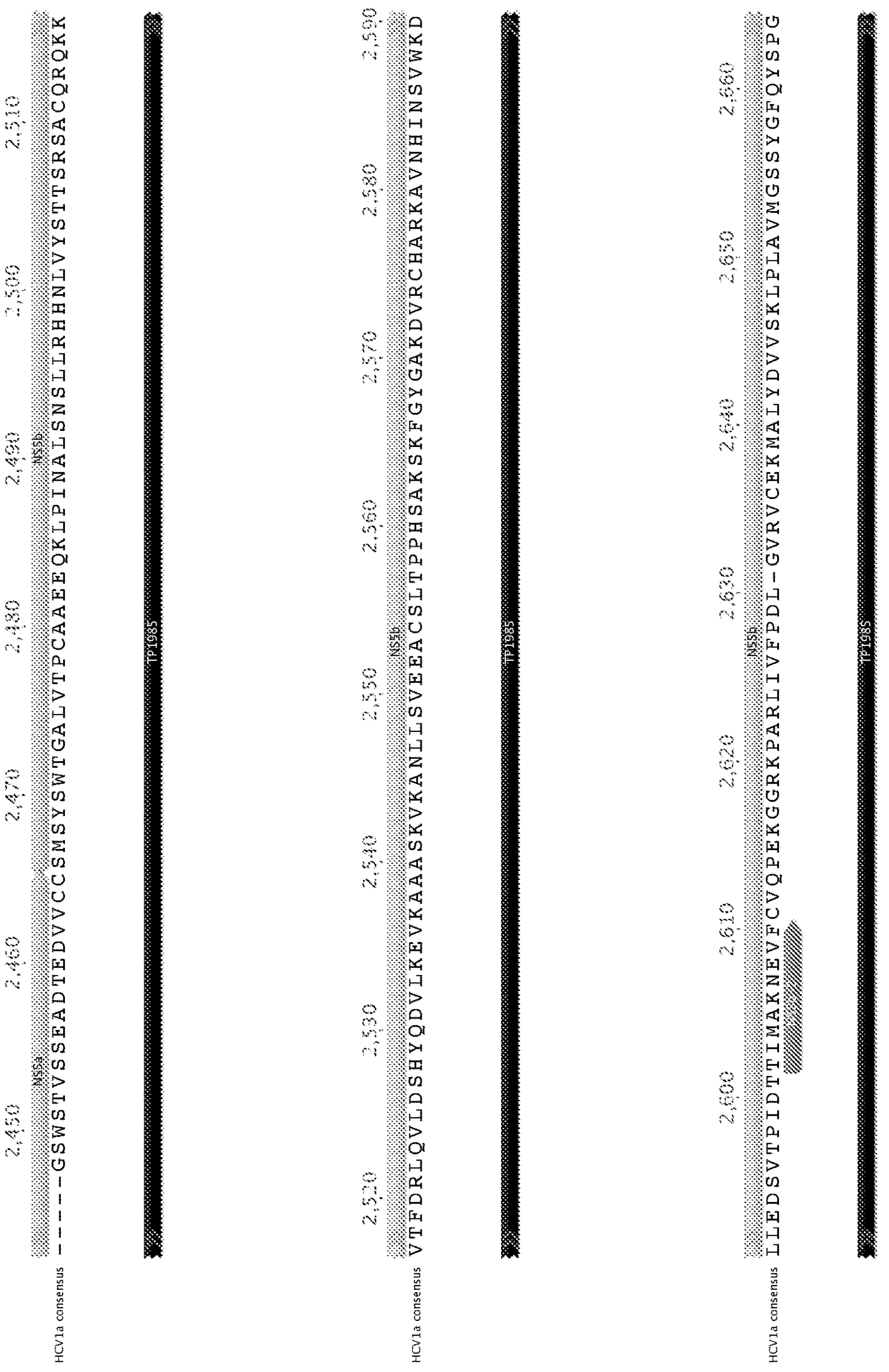
Figure 11M:
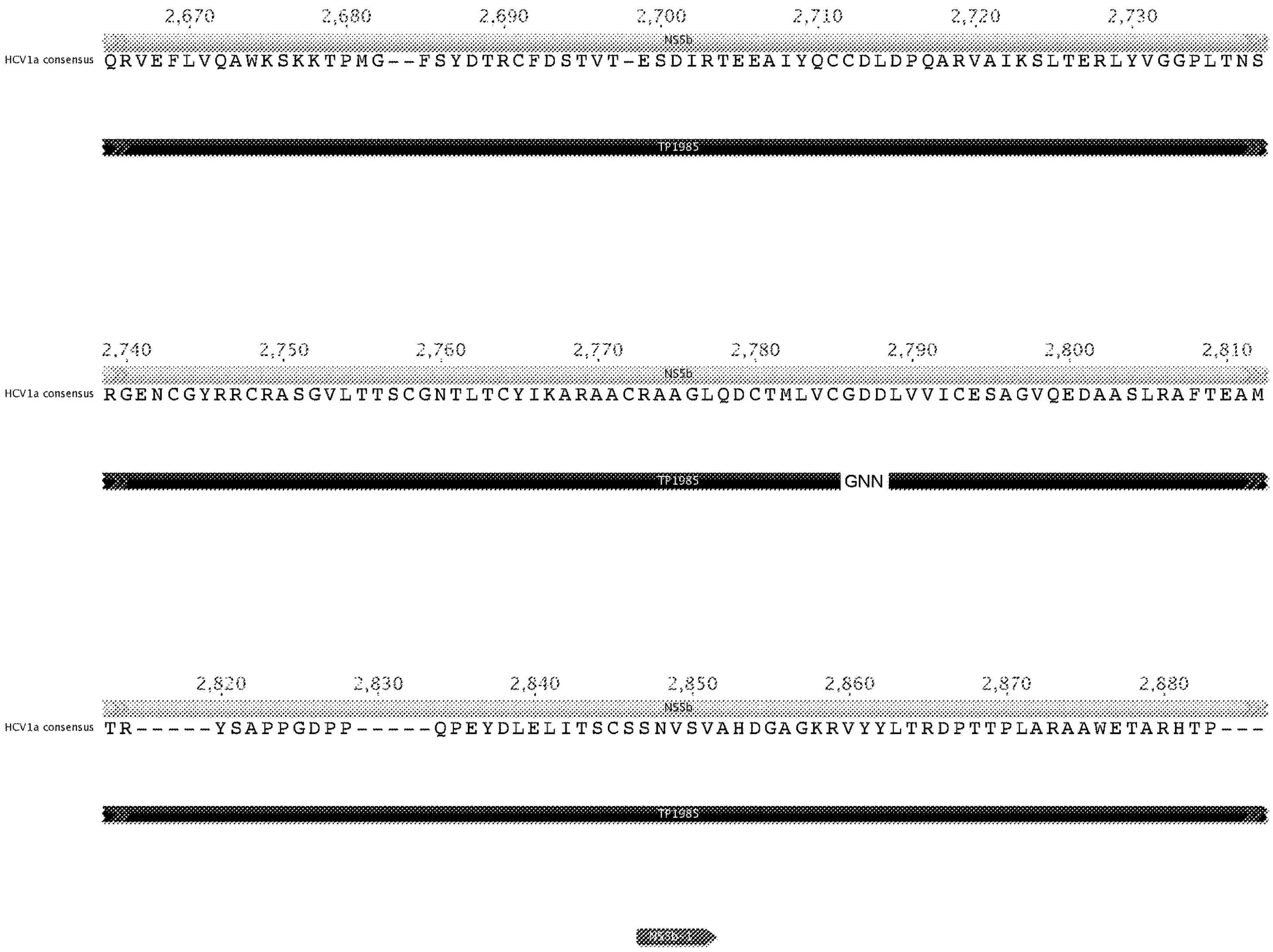
Figure 11N:
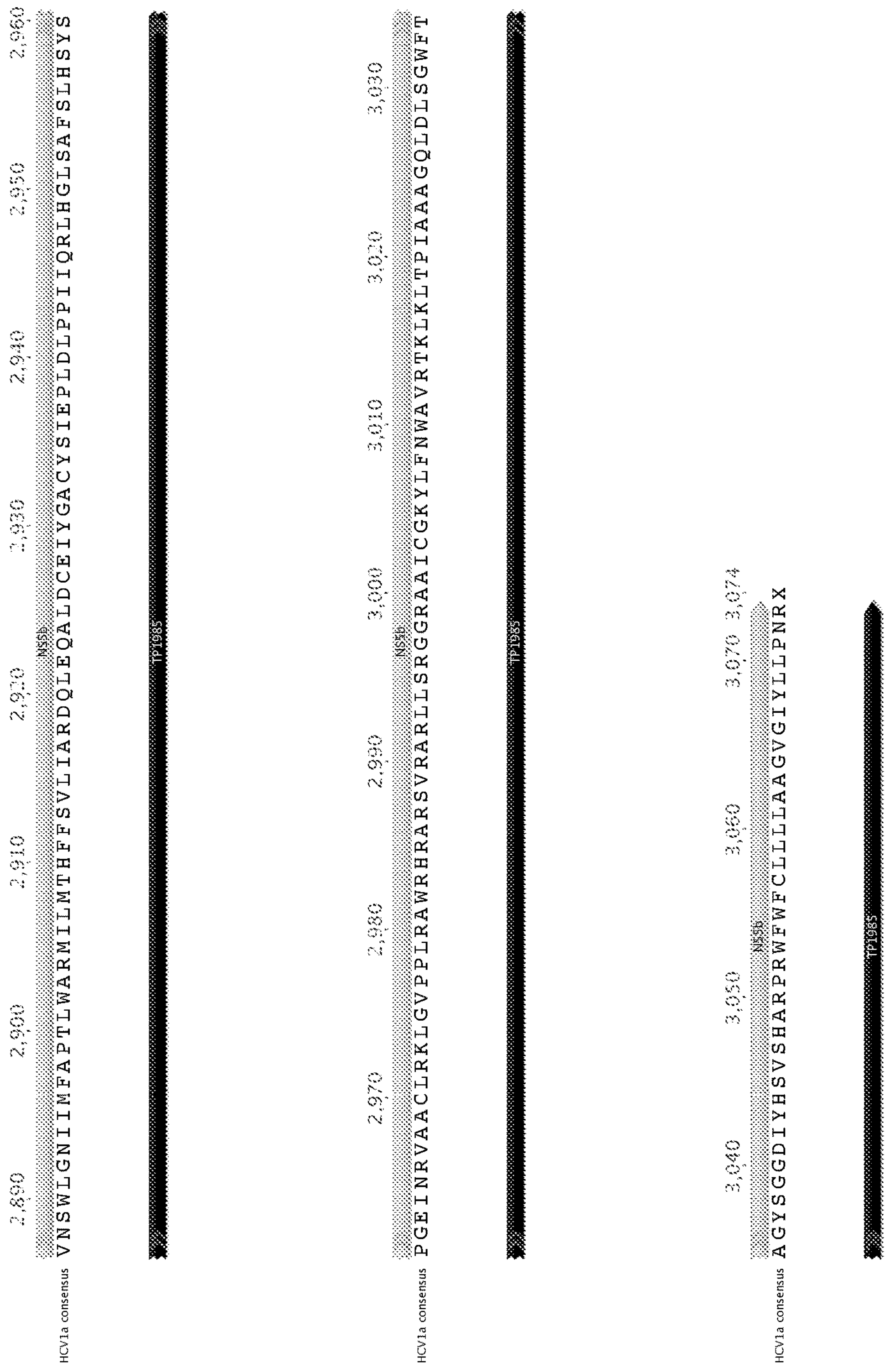

In some cases, the heterologous polypeptide present in an immunogenic composition of the present disclosure includes one or more T-cell epitopes present in an HCV NS2 polypeptide. Examples of T-cell epitopes present in NS2 polypeptides are depicted in FIG. 11A-11N, and FIG. 9A.

For example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 955-974 of the amino acid sequence designated "Consensus" in FIG. 12A-12L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 975-994 of the amino acid sequence designated "Consensus" in FIG. 12A-12L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 985-1004 of the amino acid sequence designated "Consensus" in FIG. 12A-12L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1015-1034 of the amino acid sequence designated "Consensus" in FIG. 12A-12L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1035-1054 of the amino acid sequence designated "Consensus" in FIG. 12A-12L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 924-933 of the amino acid sequence designated "Consensus" in FIG. 12A-12L, or a corresponding HCV NS2 amino acid sequence of any HCV genotype; and the NS2 T cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 961-970 of the amino acid sequence designated "Consensus" in FIG. 12A-12L, or a corresponding HCV NS2 amino acid sequence of any HCV genotype; and the NS2 T cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 989-997 of the amino acid sequence designated "Consensus" in FIG. 12A-12L, or a corresponding HCV NS2 amino acid sequence of any HCV genotype; and the NS2 T cell epitope can have a length of from 9 amino acids (aa) to 15 amino acids (e.g., 9 aa, 10 aa, 11 aa, 12 aa, 13 aa, 14 aa, or 15 aa).

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 50 aa (e.g., from 10 aa to 25 aa, or from 25 aa to 50 aa) of amino acids 955-1004 of the amino acid sequence designated "Consensus" in FIG. 12A-12L, or a corresponding HCV NS2 amino acid sequence of any HCV genotype; and has a length of from 10 amino acids (aa) to 25 aa, or from 25 aa to 50 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 955-1004 of the amino acid sequence designated "Consensus" in FIG. 12A-12L, or a corresponding HCV NS2 amino acid sequence of any HCV genotype; and has a length of about 50 amino acids.

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 553 aa (e.g., from 10 aa to 25 aa, from 25 aa to 50 aa, from 50 aa to 100 aa, from 100 aa to 200 aa, from 200 aa to 300 aa, from 300 aa to 400 aa, from 400 aa to 500 aa, or from 500 aa to 553 aa) of amino acids 917-1469 of the amino acid sequence designated "Consensus" in FIG. 12A-12L, or a corresponding HCV NS2 and NS3 amino acid sequence of any HCV genotype; and has a length of from 10 amino acids (aa) to 25 aa, from 25 aa to 50 aa, from 50 aa to 100 aa, from 100 aa to 200 aa, from 200 aa to 300 aa, from 300 aa to 400 aa, from 400 aa to 500 aa, or from 500 aa to 553 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 917-1469 of the amino acid sequence designated "Consensus" in FIG. 12A-12L, or a corresponding HCV NS2 and NS3 amino acid sequence of any HCV genotype; and has a length of about 553 amino acids.

The heterologous polypeptide can comprise an amino acid sequence having at least about 20%, at least about 25%, at least about 30%, at least about 35%, at least about 40%, at least about 45%, at least about 50%, at least about 60%, at least about 0%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRDWAHNGLRDLAVAVE-PVVFSQMETKLITWGADT (SEQ ID NO:99). LGALTGTYVYNHLTPLRDWAHNGLRDLAVAVE-PVVFSQMETKLITWGADT (SEQ ID NO:99) is referred to in FIG. 10A as "TP50." In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRDWAHNGLRDLAVAVE-PVVFSQMETKLITWGADT (SEQ ID NO:99); and has a length of from 50 amino acids to 60 amino acids (e.g., 50 aa, 51 aa, 52 aa, 53 aa, 54 aa, 55 aa, 56 aa, 57 aa, 58 aa, 59 aa, or 60 aa). In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRD-WAHNGLRDLAVAVEPVVFSQMETKLITWGADT (SEQ ID NO:99); and has a length of 50 amino acids. Such a polypeptide can include NS2 T-cell epitopes designated NS2-1, NS2-2, NS2-3, NS2-7, and NS2-8 in FIG. 9A and FIG. 11A-11N.

HCV NS4A T-Cell Epitopes

In some cases, the heterologous polypeptide present in an immunogenic composition of the present disclosure includes one or more T-cell epitopes present in an HCV NS4A polypeptide. Examples of T-cell epitopes present in NS4A polypeptides are depicted in FIG. 11A-11N and FIG. 9B.

The heterologous polypeptide can comprise an NS4A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1683-1692 of the amino acid sequence designated "Consensus" in FIG. 12A-12L, or a corresponding HCV NS4A amino acid sequence of any HCV genotype; and the NS4A T-cell epitope can have a length of from 10 amino acids (aa) to 15 amino acids (e.g., 10 aa, 11 aa, 12 aa, 13 aa, 14 aa, or 15 aa).

HCV NS4B T-Cell Epitopes

In some cases, the heterologous polypeptide present in an immunogenic composition of the present disclosure includes one or more T-cell epitopes present in an HCV NS4B polypeptide. Examples of T-cell epitopes present in NS4B polypeptides are depicted in FIG. 11A-11N and FIG. 9B.

As one example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1790-1801 of the amino acid sequence designated "Consensus" in FIG. 12A-12L, or a corresponding HCV NS4B amino acid sequence of any HCV genotype; and the NS4B T-cell epitope can have a length of from 12 amino acids (aa) to 20 amino acids (e.g., 12 aa, 13 aa, 14 aa, 15 aa, 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1792-1802 of the amino acid sequence designated "Consensus" in FIG. 12A-12L, or a corresponding HCV NS4B amino acid sequence of any HCV genotype; and the NS4B T-cell epitope can have a length of from 11 amino acids (aa) to 20 amino acids (e.g., 11 aa, 12 aa, 13 aa, 14 aa, 15 aa, 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1898-1905 of the amino acid sequence designated "Consensus" in FIG. 12A-12L, or a corresponding HCV NS4B amino acid sequence of any HCV genotype; and the NS4B T-cell epitope can have a length of from 8 amino acids (aa) to 15 amino acids (e.g., 8 aa, 9 aa, 10 aa, 11 aa, 12 aa, 13 aa, 14 aa, or 15 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1921-1935 of the amino acid sequence designated "Consensus" in FIG. 12A-12L, or a corresponding HCV NS4B amino acid sequence of any HCV genotype; and the NS4B T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1922-1941 of the amino acid sequence designated "Consensus" in FIG. 12A-12L, or a corresponding HCV NS4B amino acid sequence of any HCV genotype; and the NS4B T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1928-1947 of the amino acid sequence designated "Consensus" in FIG. 12A-12L, or a corresponding HCV NS4B amino acid sequence of any HCV genotype; and the NS4B T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1868-1876 of the amino acid sequence designated "Consensus" in FIG. 12A-12L, or a corresponding HCV NS4B amino acid sequence of any HCV genotype; and the NS4B T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1927-1942 of the amino acid sequence designated "Consensus" in FIG. 12A-12L, or a corresponding HCV NS4B amino acid sequence of any HCV genotype; and the NS4B T-cell epitope can have a length of from 16 amino acids (aa) to 20 amino acids (e.g., 16 aa, 17 aa, 18 aa, 19 aa, or 20 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1932-1940 of the amino acid sequence designated "Consensus" in FIG. 12A-12L, or a corresponding HCV NS4B amino acid sequence of any HCV genotype; and the NS4B T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1948-1962 of the amino acid sequence designated "Consensus" in FIG. 12A-12L, or a corresponding HCV NS4B amino acid sequence of any HCV genotype; and the NS4B T-cell epitope can have a length of from 15 amino acids (aa) to 20 amino acids (e.g., 15 aa, 16 aa, 17 aa, 18 aa, 19 aa, or 20 aa).

HCV NS5A T-Cell Epitopes

In some cases, the heterologous polypeptide present in an immunogenic composition of the present disclosure includes one or more T-cell epitopes present in an HCV NS5A polypeptide. Examples of T-cell epitopes present in NS5A polypeptides are depicted in FIG. 11A-11N and FIG. 9B.

As one example, the heterologous polypeptide can comprise an NS5A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2218-2232 of the amino acid sequence designated “Consensus” in FIG. 12A-12L, or a corresponding HCV NS5A amino acid sequence of any HCV genotype; and the NS5A T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an NS5A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2309-2317 of the amino acid sequence designated “Consensus” in FIG. 12A-12L, or a corresponding HCV NS5A amino acid sequence of any HCV genotype; and the NS5A T-cell epitope can have a length of from 9 amino acids (aa) to 15 amino acids (e.g., 9 aa, 10 aa, 11 aa, 12 aa, 13 aa, 14 aa, or 15 aa).

HCV NS5B T-cell epitopes

In some cases, the heterologous polypeptide present in an immunogenic composition of the present disclosure includes one or more T-cell epitopes present in an HCV NS5B polypeptide. Examples of T-cell epitopes present in NS5B polypeptides are depicted in FIG. 11A-11N and FIG. 9B.

As one example, the heterologous polypeptide can comprise an NS5B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2847-2851 of the amino acid sequence designated “Consensus” in FIG. 12A-12L, or a corresponding HCV NS5B amino acid sequence of any HCV genotype; and the NS5B T-cell epitope can have a length of from 5 amino acids (aa) to 10 amino acids (e.g., 5 aa, 6 aa, 7 aa, 8 aa, 9 aa, or 10 aa).

As another example, the heterologous polypeptide can comprise an NS5B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2602-2610 of the amino acid sequence designated “Consensus” in FIG. 12A-12L, or a corresponding HCV NS5B amino acid sequence of any HCV genotype; and the NS5B T-cell epitope can have a length of from 9 amino acids (aa) to 15 amino acids (e.g., 9 aa, 10 aa, 11 aa, 12 aa, 13 aa, 14 aa, or 15 aa).

HCV Core T-Cell Epitopes

In some cases, the heterologous polypeptide present in an immunogenic composition of the present disclosure includes one or more T-cell epitopes present in an HCV core polypeptide. Examples of T-cell epitopes present in HCV Core polypeptides are depicted in FIG. 11A-11N and FIG. 9A.

As one example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1-20 of the amino acid sequence designated “Consensus” in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 11-30 of the amino acid sequence designated “Consensus” in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 21-40 of the amino acid sequence designated “Consensus” in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 39-63 of the amino acid sequence designated “Consensus” in FIG. 12A-12L, or a corresponding HCV core amino acid sequence of any HCV genotype; and the HCV core T-cell epitope can have a length of from 23 amino acids (aa) to 28 amino acids (e.g., 23 aa, 24 aa, 25 aa, 26 aa, 27 aa, or 28 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 47-70 of the amino acid sequence designated “Consensus” in FIG. 12A-12L, or a corresponding HCV core amino acid sequence of any HCV genotype; and the HCV core T-cell epitope can have a length of from 24 amino acids (aa) to 29 amino acids (e.g., 24 aa, 25 aa, 26 aa, 27 aa, 28 aa, or 29 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 61-80 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 71-90 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 81-100 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 91-110 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 101-115 of the amino acid sequence designated "Consensus" in FIG. 12A-12L, or a corresponding HCV core amino acid sequence of any HCV genotype; and the HCV core T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 111-130 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 125-139 of the amino acid sequence designated "Consensus" in FIG. 12A-12L, or a corresponding HCV core amino acid sequence of any HCV genotype; and the HCV core T-cell epitope can have a length of from 15 amino acids (aa) to 20 amino acids (e.g., 15 aa, 16 aa, 17 aa, 18 aa, 19 aa, or 20 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 131-150 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 151-170 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 161-180 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 35-44 of the amino acid sequence designated "Consensus" in FIG. 12A-12L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 43-51 of the amino acid sequence designated "Consensus" in FIG. 12A-12L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 51-59 of the amino acid sequence designated "Consensus" in FIG. 12A-12L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 129-137 of the amino acid sequence designated "Consensus" in FIG. 12A-12L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 131-140 of the amino acid sequence designated "Consensus" in FIG. 12A-12L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 150-158 of the amino acid sequence designated "Consensus" in FIG. 12A-12L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 154-162 of the amino acid sequence designated "Consensus" in FIG. 12A-12L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 168-176 of the amino acid sequence designated "Consensus" in FIG. 12A-12L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 177-187 of the amino acid sequence designated "Consensus" in FIG. 12A-12L, or a corresponding HCV core amino acid sequence of any HCV genotype; and the HCV core T-cell epitope can have a length of from 11 amino acids (aa) to 16 amino acids (e.g., 11 aa, 12 aa, 13 aa, 14 aa, 15 aa, or 16 aa).

As another example, the heterologous polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 178-187 of the amino acid sequence designated "Consensus" in FIG. 12A-12L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 191 aa (e.g., from 10 aa to 25 aa, from 25 aa to 50 aa, from 50 aa to 75 aa, from 75 aa to 100 aa, from 100 aa to 150 aa, or from 150 aa to 191aa) of amino acids 1-191 of the amino acid sequence designated "Consensus" in FIG. 12A-12L, or a corresponding HCV core amino acid sequence of any HCV genotype; and has a length of from 10 amino acids (aa) to 25 aa, from 25 aa to 50 aa, from 50 aa to 100 aa, or from 100 aa to 150 aa, or from 150 aa to 191 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1-191 of the amino acid sequence designated "Consensus" in FIG. 12A-12L, or a corresponding HCV core amino acid sequence of any HCV genotype; and has a length of about 191 amino acids.

The heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQI-VGGVYLLPRRGPRLGVRATRKTSERSQP RGRRQPIPKARRPEGRTWAQPGYPWPLYGNEGCG-WAGWLLSPRGSRPSWGPTDPRRRS RNLGKVIDTLTCGFADLMGYIPLVGAPLGGAARAL-AHGVRVLEDGVNYATGNLPG (SEQ ID NO:89); and has a length of from 171 amino acids (aa) to 180 aa (e.g., 171 aa, 172 aa, 173 aa, 174 aa, 175 aa, 176 aa, 177 aa, 178 aa, 179 aa, or 180 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRN-TNRRPQDVKFPGGGQIVGGVYLL-PRRGPRLGVRATRKTSERSQP RGRRQPIPKARRPEGRTWAQPGYPWPLYGNEGCG-WAGWLLSPRGSRPSWGPTDPRRRS RNLGKVIDTLTCGFADLMGYIPLVGAPLGGAARAL-AHGVRVLEDGVNYATGNLPG (SEQ ID NO:89); and has a length of 171 amino acids. Such a polypeptide can include core T-cell epitopes designated Core-1, Core-2, Core-3, Core-4, Core-5, Core-6, Core-7, Core-8, Core-9, Core-10, Core-11, Core-12, Core-13, Core-14, Core-16, Core-17, Core-18, Core-19, Core-20, Core-21, Core-22 in FIG. 9A and FIG. 11A-11N.

HCV p7 T-Cell Epitopes

In some cases, the heterologous polypeptide present in an immunogenic composition of the present disclosure includes one or more T-cell epitopes present in an HCV p7 polypeptide. Examples of T-cell epitopes present in HCV p7 polypeptides are depicted in FIG. 11A-11N or FIG. 9A.

As another example, the heterologous polypeptide can comprise an HCV p7 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 803-811 of the amino acid sequence designated "Consensus" in FIG. 12A-12L, or a corresponding HCV p7 amino acid sequence of any HCV genotype; and the HCV p7 T-cell epitope can have a length of from 9 amino acids (aa) to 15 amino acids (e.g., 9 aa, 10 aa, 11 aa, 12 aa, 13 aa, 14 aa, or 15 aa).

Heterologous Polypeptides Including HCV T-Cell Epitopes from More than One HCV Polypeptide Other than E1 and E2

As noted above, a heterologous polypeptide can include T-cell epitopes from more than one HCV polypeptide other than E1 and E2.

As one example, a heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: QASLLKVPYFVRVQGLLRICALARK-MAGGHYVQMAIIKLGALTGTYVYNALTPLRDW AHNGLRDLAVAVEPVVFSQMETKLITWGADTAACG-DIINGLPVSARRGREILLGPADG MVSKGWRLLAPI-TAYAQQTRGLLGCIITSLTGRDKNQVEGEVQI-VSTAAQTFLATCING VCWTVYHGAGTRTIAS-PKGPVIQMYTNVDQDLVGW-PAPQGARSLTPCTCGSSDLYLVT RHAD-VIPVRRRGDSRGSLLSPRPISYLKGS AGGPLLCPAGHAVGIFRAAVCTRGVAKAV DFIPVEN-LETTMRSPVFTDNSSPPAVPQSFQVAHLHAPTGSGK-STKVPAAYAAQGYKVL VLNPSVAATLGF-GAYMSKAHGIDPNIRTGVRTITTGSPITYSTYGKFLA DGGCSGGAYDII ICDECHSTDATSIL-GIGTVLDQAETAGARLVVLATATPPGSVTVPHPNIE-EVALSTTGEIPF YGKAIPLEVIKGGRHLIFCHS-KKKCDELAAKLVALGINAVAYYRGLDVSVIPTSGD VVV VATDALMTGFTGDFDSVIDCN (SEQ ID NO:100); and has a length of from 550 amino acids (aa) to 560 aa (e.g., 550 aa, 551 aa, 552 aa, 553 aa, 554 aa, 555 aa, 556 aa, 557 aa, 558 aa, 559 aa, or 560 aa).

QASLLKVPYFVRVQGLLRICALARKMAGGHYVQ-MAIIKLGALTGTYVYNALTP LRDWAHNGLRDLAVA-VEPVVFSQMETKLITWGADTAACGDIINGLPVSARR-GREILLGP

ADGMVSKGWRLLAPITAYAQQTRGLLGCIITSLT- GRDKNQVEGEVQIVSTAAQTFLATC INGVCWTVYHGAGTRTIAS- PKGPVIQMYTNVDQDLVGW- PAPQGARSLTPCTCGSSDLY LVTRHAD- VIPVRRRGDSRGSLLSPRPISYLKGS AGGPLLCPAGHAVGIFRAAVCTRGVAK AVDFIPVEN- LETTMRSPVFTDNSSPPAVPQSFQVAHLHAPTGSGK- STKVPAAYAAQGYK VLVLNPSVAATLGF- GAYMSKAHGIDPNIRTGVRTITTGSPITYSTYGKFLA DGGCSGGAY DIIICDECHSTDATSIL- GIGTVLDQAETAGARLVVLATATPPGSVTVPHPNIE- EVALSTTGE IPFYGKAIPLEVIKGGRHLIFCHS- KKKCDELAAKLVALGINAVAYYRGLDVSVIPTSGDV VVVATDALMTGFTGDFDSVIDCN (SEQ ID NO:100) is referred to in FIG. 10A-10B as "TP553."

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: QASLLKVPYFVRVQGLLRICALARK- MAGGHYVQMAIIKLGALTGTYVYNALTPLRDW AHNGLRDLAVAVEPVVFSQMETKLITWGADTAACG- DIINGLPVSARRGREILLGPADG MVSKGWRLLAPI- TAYAQQTRGLLGCIITSLTGRDKNQVEGEVQI- VSTAAQTFLATCING VCWTVYHGAGTRTIAS- PKGPVIQMYTNVDQDLVGW- PAPQGARSLTPCTCGSSDLYLVT RHAD- VIPVRRRGDSRGSLLSPRPISYLKGS AGGPLLCPAGHAVGIFRAAVCTRGVAKAV DFIPVEN- LETTMRSPVFTDNSSPPAVPQSFQVAHLHAPTGSGK- STKVPAAYAAQGYKVL VLNPSVAATLGF- GAYMSKAHGIDPNIRTGVRTITTGSPITYSTYGKFLA DGGCSGGAYDII ICDECHSTDATSIL- GIGTVLDQAETAGARLVVLATATPPGSVTVPHPNIE- EVALSTTGEIPF YGKAIPLEVIKGGRHLIFCHS- KKKCDELAAKLVALGINAVAYYRGLDVSVIPTSGD VVV VATDALMTGFTGDFDSVIDCN (SEQ ID NO:100); and has a length of 553 amino acids. Such a polypeptide can include T-cell epitopes designated NS2-1, NS2-2, NS2-3, NS2-4, NS2-5, NS2-6, NS2-7, NS2-8, NS3-1, NS3-2, NS3-3, NS3-4, NS3-5, NS3-6, NS3-7, NS3-9, NS3-10, NS3-11, NS3-12, and NS3-13 in FIG. 9A-9B and FIG. 11A-11N. This polypeptide is also referred to as "TP553" (FIG. 12A-12D). In order to prevent self cleavage of the TP553 polypeptide (amino acids 917-1469) (FIG. 11E-11G) at the NS2-NS3 junction that is mediated by the catalytic domain of the NS2 protease (amino acids 917-1040), the histidine at position 966 (H966), a critical residue for NS2 protease activity, is mutated to alanine (H966A) (FIG. 11E). See, e.g., Grakoui, A. et al. A second hepatitis C virus-encoded proteinase. Proc. Natl Acad. Sci. USA 90, 10583-10587 (1993); Hijikata, M. et al. Two distinct proteinase activities required for the processing of a putative nonstructural precursor protein of hepatitis C virus. J. Virol. 67, 4665-4675 (1993); and Lorenz. I C. Structure of the catalytic domain of the hepatitis C virus NS2-3 protease. Nature. August 17; 442(7104):831-5 (2006).

As another example, the heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 778 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 450 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 778 aa) the following amino acid sequence: LHAPTGSGK- STKVPAAYAAQGYKVLVLNPSVAATLGF- GAYMSKAHGIDPNIRTGVRTIT TGSPITYSTYGK- FLADGGCSGGAYDIIICDECHSTDATSILGIGTVLDQ AETAGARLVVLA TATPPGSVTVPHPNIEEVALSTT- GEIPFYGKAIPLEVIKGGRHLIFCHSKKKCDE- LAAKLV ALGINAVAYYRGLDVSVIPTSGDVVV- VATDALMTGFTGDFDSVIDCNTCVTQTVDFSLD PTFTIETTTLPQDAVSRTQRRGRT- GRGKPGIYRFVAPGERPSGMFDSSVLCECYDAGCA WYELTPAETTVRL- RAYMNTPGLPVCQDHLEFWEGVFTGLTHI- DAHFLSQTKQSGENLP YLVAYQATVCAR- AQAPPPSWDQMWKCLIRLKPTLHGPTPLLYRLGAVQ- NEVTLTHPIT KYIMTCMSADLEVVTSTWVLVGGVLAALAAYCL- STGCVVIVGRIVLSGKPAIIPDREVL YREFDE- MEECSQHLPYIEQGMMLAEQFKQKALGLLQTAS- RQAEVIAPAVQTNWQKLEA FWAKHMWNFISGIQYLAGLSTLPGNPAIASLMA- FTAAVTSPLTTSQTLLFNILGGWVAA QLAAP- GAATAFVGAGLAGAAIGSVGLGKVLVDI- LAGYGAGVAGALVAFKIMSGEVPST EDLVNLLPAILSPGALVVGVVCAAILR- RHVGPGEGAVQWMNRLIAFASRGNHVSPTHY VPES- DAAARV- TAILSSLTVTQLLRRLHQWISSECTTPCSGSWLRDIWD- WICEVLSDFKTW LKAKLMPQLPG (SEQ ID NO:101); and has a length of from 778 amino acids (aa) to 790 aa (e.g., 778 aa, 779 aa, 780 aa, 781 aa, 782 aa, 783 aa, 784 aa, 785 aa, 786 aa, 787 aa, 788 aa, or 790 aa).

LHAPTGSGK- STKVPAAYAAQGYKVLVLNPSVAATLGF- GAYMSKAHGIDPNIRT GVRTITTGSPITYSTYGK- FLADGGCSGGAYDIIICDECHSTDATSILGIGTVLDQ AETAGA RLVVLATATPPGSVTVPHPNIEEVALSTT- GEIPFYGKAIPLEVIKGGRHLIFCHSKKKCDE LAAK- LVALGINAVAYYRGLDVSVIPTSGDVVV- VATDALMTGFTGDFDSVIDCNTCVTQ TVDFSLDPTFTIETTTLPQDAVSRTQRRGRT- GRGKPGIYRFVAPGERPSGMFDSSVLCEC YDAG- CAWYELTPAETTVRL- RAYMNTPGLPVCQDHLEFWEGVFTGLTHIDAHFLS QTKQ SGENLPYLVAYQATVCAR- AQAPPPSWDQMWKCLIRLKPTLHGPTPLLYRL- GAVQNEVT LTHPITKYIMTCMSA- DLEVVTSTWVLVGGVLAALAAYCLSTGCVVIVGRI VLSGKPAIIP DREVLYREFDEMEECSQHLPYIEQGM- MLAEQFKQKALGLLQTASRQAEVIAPAVQTNW QKLEAFWAKHMWNFISGIQYLAGLSTLPGNPAIASL- MAFTAAVTSPLTTSQTLLFNILGG WVAAQLAAP- GAATAFVGAGLAGAAIGSVGLGKVLVDI-

LAGYGAGVAGALVAFKIMSG EVPSTEDLVNLLPAILSPGALVVGVVCAAILR-RHVGPGEGAVQWMNRLIAFASRGNHVS PTHYVPES-DAAARV-TAILSSLTVTQLLRRLHQWISSECTTPCSGSWLRDI WDWICEVLSD FKTWLKAKLMPQLPG (SEQ ID NO:101) is referred to in FIG. 10B as "TP778."

In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 778 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 450 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 778 aa) of the following amino acid sequence: LHAPTGSGK-STKVPAAYAAQGYKVLVLNPSVAATLGF-GAYMSKAHGIDPNIRTGVRTIT TGSPITYSTYGK-FLADGGCSGGAYDIIICDECHSTDATSILGIGTVLDQ AETAGARLVVLA TATPPGSVTVPHPNIEEVALSTT-GEIPFYGKAIPLEVIKGGRHLIFCHSKKKCDE-LAAKLV ALGINAVAYYRGLDVSVIPTSGDVVV-VATDALMTGFTGDFDSVIDCNTCVTQTVDFSLD PTFTIETTTLPQDAVSRTQRRGRT-GRGKPGIYRFVAPGERPSGMFDSSVLCECYDAGCA WYELTPAETTVRL-RAYMNTPGLPVCQDHLEFWEGVFTGLTHI-DAHFLSQTKQSGENLP YLVAYQATVCAR-AQAPPPSWDQMWKCLIRLKPTLHGPTPLLYRLGAVQ-NEVTLTHPIT KYIMTCMSADLEVVTSTWVLVGGVLAALAAYCL-STGCVVIVGRIVLSGKPAIIPDREVL YREFDE-MEECSQHLPYIEQGMMLAEQFKQKALGLLQTAS-RQAEVIAPAVQTNWQKLEA FWAKHMWNFISGIQYLAGLSTLPGNPAIASLMA-FTAAVTSPLTTSQTLLFNILGGWVAA QLAAP-GAATAFVGAGLAGAAIGSVGLGKVLVDI-LAGYGAGVAGALVAFKIMSGEVPST EDLVNLLPAILSPGALVVGVVCAAILR-RHVGPGEGAVQWMNRLIAFASRGNHVSPTHY VPES-DAAARV-TAILSSLTVTQLLRRLHQWISSECTTPCSGSWLRDI WDWICEVLSDFKTW LKAKLMPQLPG (SEQ ID NO:101); and has a length of from 25 amino acids (aa) to 50 aa, from 50 aa to 100 aa, from 100 aa to 200 aa, from 200 aa to 300 aa, from 300 aa to 400 aa, from 400 aa to 500 aa, from 500 aa to 600 aa, from 600 aa to 700 aa, or from 700 aa to 778 aa. In some cases, the heterologous polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGSGK-STKVPAAYAAQGYKVLVLNPSVAATLGF-GAYMSKAHGIDPNIRTGVRTIT TGSPITYSTYGKFLADGGCSGGAYDIIICDECHSTDAT-SILGIGTVLDQAETAGARLVVLA TATPPGSVTVPHPNIEEVALSTTGEIPFYGKAIPLEV-IKGGRHLIFCHSKKKCDELAAKLV ALGINAVAYYR-GLDVSVIPTSGDVVV-VATDALMTGFTGDFDSVIDCNTCVTQTVDFSLD PTFTIETTTLPQDAVSRTQRRGRT-GRGKPGIYRFVAPGERPSGMFDSSVLCECYDAGCA WYELTPAETTVRL-RAYMNTPGLPVCQDHLEFWEGVFTGLTHI-DAHFLSQTKQSGENLP YLVAYQATVCAR-AQAPPPSWDQMWKCLIRLKPTLHGPTPLLYRLGAVQ-NEVTLTHPIT KYIMTCMSADLEVVTSTWVLVGGVLAALAAYCL-STGCVVIVGRIVLSGKPAIIPDREVL YREFDE-MEECSQHLPYIEQGMMLAEQFKQKALGLLQTAS-RQAEVIAPAVQTNWQKLEA FWAKHMWNFISGIQYLAGLSTLPGNPAIASLMA-FTAAVTSPLTTSQTLLFNILGGWVAA QLAAP-GAATAFVGAGLAGAAIGSVGLGKVLVDI-LAGYGAGVAGALVAFKIMSGEVPST EDLVNLLPAILSPGALVVGVVCAAILR-RHVGPGEGAVQWMNRLIAFASRGNHVSPTHY VPES-DAAARV-TAILSSLTVTQLLRRLHQWISSECTTPCSGSWLRDI WDWICEVLSDFKTW LKAKLMPQLPG (SEQ ID NO:101); and has a length of 778 amino acids. Such a polypeptide can include T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS2-14, NS4a-1, NS4b-1, NS4b-2, NS4b-3, NS4b-4, NS4b-5, NS4b-6, NS4b-7, NS4b-8, NS4b-9, and NS4b-10 in FIG. 9B and FIG. 11A-11N.

As another example, the heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 1985 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 500 aa, from 500 aa to 750 aa, from 750 aa to 1000 aa, from 1000 aa to 1500 aa, or from 1500 aa to 1985 aa) of the following amino acid sequence: API-TAYAQQTRGLLGCIITSLTGRDKNQVEGEVQI-VSTAAQTFLATCINGVCWTVYHGA GTRTIAS-PKGPVIQMYTNVDQDLVGWPAPQGARSLTPCTCGS SDLYLVTRHADVIPVRR RGDSRGSLLSPRPISYLKGS AGGPLLCPAGHAVGIFRAAVCTRGVAKAVDFIPVEN LETT MRSPVFTDNSSPPAVPQSFQVAHLHAPTGSGK-STKVPAAYAAQGYKVLVLNPSVAATL GFGAYMSKAHGIDPNIRTGVRTITTGSPITYSTYGK-FLADGGCSGGAYDIIICDECHSTDA TSIL-GIGTVLDQAETAGARLVVLATATPPGSVTVPHPNIE-EVALSTTGEIPFYGKAIPLEVI KGGRHLIFCHSKKKCDELAAKLVALGINAVAYYR-GLDVSVIPTSGDVVVVATDALMTG FTGDFDSVIDCNTCVTQTVDFSLDPTFTIETTTLPQ-DAVSRTQRRGRTGRGKPGIYRFVAP GERPSGMFDSSVLCECYDAGCAWYELTPAETTVRL-RAYMNTPGLPVCQDHLEFWEGV FTGLTHI-DAHFLSQTKQSGENLPYLVAYQATVCAR-AQAPPPSWDQMWKCLIRLKPTLH GPTPLLYRLGAVQNEVTLTHPITKYIMTCMSA-DLEVVTSTWVLVGGVLAALAAYCLST GCV-VIVGRIVLSGKPAIIPDREVLYREFDE- MEECSQHLPYIEQGMMLAEQFKQKALGLLQ
TASRQAEVIAPAVQTNWQKLEAFWAKHMWNFIS-
GIQYLAGLSTLPGNPAIASLMAFTA AVT-
SPLTTSQTLLFNILGGWVAAQLAAPGAATAFVGAGL-
AGAAIGSVGLGKVLVDILAG
YGAGVAGALVAFKIMSGEVPSTEDLVNLLPAILSP-
GALVVGVVCAAILRRHVGPGEGAV QWMNRLIAFAS-
RGNHVSPTHYVPESDAAARV-
TAILSSLTVTQLLRRLHQWISSECTTPCS
GSWLRDIWDWICEVLSDFKTWLKAKLMPQLP-
GIPFVSCQRGYRGVWRGDGIMHTRCH
CGAEITGHVKNGTMRIVGPRTCRNMWSGTFPINAY-
TTGPCTPLPAPNYTFALWRVSAEE
YVEIRQVGDFHYVTGMTTDNLKCPCQVPSPEF-
FTELDGVRLHRFAPPCKPLLREEVSFR VGLHEY-
PVGSQLPCEPEPDVAVLTSMLTDPSHITAEAAGRR-
LARGSPPSVASSSASQLSA
PSLKATCTANHDSPDAELIEANLLWRQEMGGNITR-
VESENKVVILDSFDPLVAEEDEREI SVPAEILRKSRR-
FAPALPIWARPDYNPPL-
LETWKKPDYEPPVVHGCPLPPPQSPPVPPPRK
KRTVVLTESTVSTALAELATKSFGSSST-
SGITGDNTTTSSEPAPSGCPPDSDAESYSSMPP
LEGEPGDPDLSDGSWSTVSSEADTEDVVCCSMSYS-
WTGALVTPCAAEEQKLPINALSNS
LLRHHNLVYSTTSRSACQRQKKVTFDRLQVLDSHY-
QDVLKEVKAAASKVKANLLSVEE ACSLTPPHSAK-
SKFGYGAKDVRCHARKAVNHINSVWKDLLEDSVT-
PIDTTIMAKNEVFC
VQPEKGGRKPARLIVFPDLGVRVCEKMALYDVVSK-
LPLAVMGSSYGFQYSPGQRVEFL VQAWK-
SKKTPMGFSYDTRCFDSTVTESDIRTEE-
AIYQCCDLDPQARVAIKSLTERLYVG
GPLTNSRGENCGYRRCRASGVLTTSCGNTLTCYIK-
ARAACRAAGLQDCTMLVCGNNLV VIC-
ESAGVQEDAASLRAFTEAMTRYSAPPGDPPQPEY-
DLELITSCSSNVSVAHDGAGKR
VYYLTRDPTTPLARAAWETARHTPVN-
SWLGNIIMFAPTLWARMILMTHFFSVLIARDQL
EQALDCEIYGACYSIEPLDLPPIIQRLHGLSAFSLH-
SYSPGEINRVAACLRKLGVPPLRAW
RHRARSVRARLLSRGGRAAICGKYLFNWAV-
RTKLKLTPIAAAGQLDLSGWFTAGYSGG
DIYHSVSHARPRWFWFCLLLLAAGVGIYLLPNR (SEQ ID NO:102); this polypeptide is also referred to as "TP1985" and is depicted in FIG. 10C.

In some cases, the heterologous polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: APITAYAQQTRGLLGCIITSLTGRDKNQVEG-
EVQIVSTAAQTFLATCINGVCWTVYHGA GTRTIAS-
PKGPVIQMYTNVDQDLVGW-
PAPQGARSLTPCTCGSSDLYLVTRHADVIPVRR
RGDSRGSLLSPRPISYLKGS
AGGPLLCPAGHAVGIFRAAVCTRGVAKAVDFIPVE
NLETT MRSPVFTDNSSPPAVPQSFQVAHLHAP-
TGSGKSTKVPAAYAAQGYKVLVLNPSVAATL
GFGAYMSKAHGIDPNIRTGVRTITTGSPITYSTYGK-
FLADGGCSGGAYDIIICDECHSTDA TSIL-
GIGTVLDQAETAGARLVVLATATPPGSVTVPHPNIE-
EVALSTTGEIPFYGKAIPLEVI
KGGRHLIFCHSKKKCDELAAKLVALGINAVAYYR-
GLDVSVIPTSGDVVVVATDALMTG
FTGDFDSVIDCNTCVTQTVDFSLDPTFTIETTTLPQ-
DAVSRTQRRGRTGRGKPGIYRFVAP
GERPSGMFDSSVLCECYDAGCAWYELTPAETTVRL-
RAYMNTPGLPVCQDHLEFWEGV FTGLTHI-
DAHFLSQTKQSGENLPYLVAYQATVCAR-
AQAPPPSWDQMWKCLIRLKPTLH
GPTPLLYRLGAVQNEVTLTHPITKYIMTCMSA-
DLEVVTSTWVLVGGVLAALAAYCLST GCV-
VIVGRIVLSGKPAIIPDREVLYREFDE-
MEECSQHLPYIEQGMMLAEQFKQKALGLLQ
TASRQAEVIAPAVQTNWQKLEAFWAKHMWNFIS-
GIQYLAGLSTLPGNPAIASLMAFTA AVT-
SPLTTSQTLLFNILGGWVAAQLAAPGAATAFVGAGL-
AGAAIGSVGLGKVLVDILAG
YGAGVAGALVAFKIMSGEVPSTEDLVNLLPAILSP-
GALVVGVVCAAILRRHVGPGEGAV QWMNRLIAFAS-
RGNHVSPTHYVPESDAAARV-
TAILSSLTVTQLLRRLHQWISSECTTPCS
GSWLRDIWDWICEVLSDFKTWLKAKLMPQLP-
GIPFVSCQRGYRGVWRGDGIMHTRCH
CGAEITGHVKNGTMRIVGPRTCRNMWSGTFPINAY-
TTGPCTPLPAPNYTFALWRVSAEE
YVEIRQVGDFHYVTGMTTDNLKCPCQVPSPEF-
FTELDGVRLHRFAPPCKPLLREEVSFR VGLHEY-
PVGSQLPCEPEPDVAVLTSMLTDPSHITAEAAGRR-
LARGSPPSVASSSASQLSA
PSLKATCTANHDSPDAELIEANLLWRQEMGGNITR-
VESENKVVILDSFDPLVAEEDEREI SVPAEILRKSRR-
FAPALPIWARPDYNPPL-
LETWKKPDYEPPVVHGCPLPPPQSPPVPPPRK
KRTVVLTESTVSTALAELATKSFGSSST-
SGITGDNTTTSSEPAPSGCPPDSDAESYSSMPP
LEGEPGDPDLSDGSWSTVSSEADTEDVVCCSMSYS-
WTGALVTPCAAEEQKLPINALSNS
LLRHHNLVYSTTSRSACQRQKKVTFDRLQVLDSHY-
QDVLKEVKAAASKVKANLLSVEE ACSLTPPHSAK-
SKFGYGAKDVRCHARKAVNHINSVWKDLLEDSVT-
PIDTTIMAKNEVFC
VQPEKGGRKPARLIVFPDLGVRVCEKMALYDVVSK-
LPLAVMGSSYGFQYSPGQRVEFL VQAWK-
SKKTPMGFSYDTRCFDSTVTESDIRTEE-
AIYQCCDLDPQARVAIKSLTERLYVG
GPLTNSRGENCGYRRCRASGVLTTSCGNTLTCYIK-
ARAACRAAGLQDCTMLVCGNNLV VIC-
ESAGVQEDAASLRAFTEAMTRYSAPPGDPPQPEY-
DLELITSCSSNVSVAHDGAGKR
VYYLTRDPTTPLARAAWETARHTPVN-
SWLGNIIMFAPTLWARMILMTHFFSVLIARDQL
EQALDCEIYGACYSIEPLDLPPIIQRLHGLSAFSLH-
SYSPGEINRVAACLRKLGVPPLRAW
RHRARSVRARLLSRGGRAAICGKYLFNWAV-
RTKLKLTPIAAAGQLDLSGWFTAGYSGG
DIYHSVSHARPRWFWFCLLLLAAGVGIYLLPNR (SEQ ID NO:102); and has a length of 1985 amino acids. Such a polypeptide can include T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10, NS5a-1, NS5a-2, NS5b-1, NS5b-2 in FIG. 9A-9B and FIG. 11A-11N.

Additional T-Cell Epitopes

As discussed above, an immunogenic composition of the present disclosure includes: a) an HCV E1/E2 heterodimer; and b) a heterologous polypeptide that comprises one or more T-cell epitopes (e.g., one or more T cell epitopes present in an HCV polypeptide other than an HCV E1 polypeptide or an HCV E2 polypeptide). The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the heterologous polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein.

Thus, in some cases, an immunogenic composition of the present disclosure includes: a) an HCV E1/E2 heterodimer; and b) a heterologous polypeptide that comprises one or more T-cell epitopes, where the one or more T-cell epitopes are T-cell epitopes present in: i) one or more of an HCV NS3 polypeptide, an HCV NS2 polypeptide, an HCV NS4A polypeptide, an HCV NS4B polypeptide, an HCV NS5A polypeptide, an HCV NS5B polypeptide, an HCV core polypeptide, and an HCV p7 polypeptide; and ii) one or more of cholera toxin or toxoid, tetanus toxin or toxoid, diphtheria toxin or toxoid, and a meningococcal outer membrane protein.

A T helper tetanus toxin epitope or other bacterial T-cell epitope could be fused (e.g., by recombinant expression) or chemically conjugated to the heterologous polypeptide, or can be unconjugated (e.g., provided as a separate polypeptide), to further enhance both T and B cell responses to both the T-cell epitopes present in the heterologous polypeptide and in the E1/E2 polypeptides. Alternatively, the whole or part of the detoxified toxin ("toxoid") can be used, wherein specific amino acids of the toxins are mutated to render the toxins inactive, thereby generating toxoids. Methods of generating toxoids are well known in the art. Examples of bacterial epitopes include the use of diphtheria toxoid, meningococcal outer membrane protein, or mutant diphtheria protein CRM197 (see, e.g.: http://www(dot)medscape(dot)com/viewarticle/431127).

In some cases, a suitable tetanus toxoid polypeptide comprises the amino acid sequence QYIKANSKFIGIFE (SEQ ID NO:103). In some cases, a suitable tetanus toxoid polypeptide comprises the amino acid sequence QYIKANSKFIGITE (SEQ ID NO:104).

In some cases, a heterologous polypeptide can comprise cholera toxin (or toxoid) epitope. In some cases, a suitable heterologous polypeptide comprising a cholera toxoid epitope comprises a fragment of cholera toxin-B subunit (CT-B), e.g., a fragment of from 5 amino acids to 25 amino acids, or from 25 amino acids to 50 amino acids, of the following amino acid sequence: MIKLKFGVFF TVLLSSAYAH GTPQNITDLC AEYHNTQIHT LNDKIFSYTE SLAGKREMAI ITFKNGATFQ VEVPGSQHID SQKKAIERMK DTLRIAYLTE AKVEKLCVWN NKTPHAIAAI SMAN (SEQ ID NO:105).

In some cases, a heterologous polypeptide can comprise a tetanus toxin (or toxoid) T-cell epitope. In some cases, a suitable heterologous polypeptide comprising a tetanus toxin T-cell epitope comprises the amino acid sequence: ILMQYIKANSKFIGI (SEQ ID NO:106); and has a length of from 15 amino acids to 20 amino acids. In some cases, a suitable heterologous polypeptide comprising a tetanus toxin T-cell epitope comprises the amino acid sequence: VNNESSE (SEQ ID NO:107). In some cases, a suitable heterologous polypeptide comprising a tetanus toxin T-cell epitope comprises the amino acid sequence: PGINGKAIHLVNNESSE (SEQ ID NO:108). In some cases, a suitable heterologous polypeptide comprising a tetanus toxin T-cell epitope comprises the amino acid sequence: PNRDIL (SEQ ID NO:109). In some cases, a suitable heterologous polypeptide comprising a tetanus toxin T-cell epitope comprises the amino acid sequence: FIGITEL (SEQ ID NO:110). In some cases, a suitable tetanus toxin T-cell epitope comprises the amino acid sequence: SYFPSV (SEQ ID NO:111). In some cases, a suitable heterologous polypeptide comprising a tetanus toxin T-cell epitope comprises the amino acid sequence: NSVDDALINSTKIYSYFPSV (SEQ ID NO:112). In some cases, a suitable heterologous polypeptide comprising a tetanus toxin T-cell epitope comprises the amino acid sequence: IDKISDVSTIVPYIGPALNI (SEQ ID NO:113).

In some cases, a heterologous polypeptide can comprise a diphtheria toxin T-cell epitope In some cases, a suitable heterologous polypeptide comprising a diphtheria toxin T-cell epitope comprises the amino acid sequence: QSIALSSLMVAQAIP (SEQ ID NO:114); and has a length of from 15 amino acids to 20 amino acids. In some cases, a suitable heterologous polypeptide comprising a diphtheria toxin T-cell epitope comprises the amino acid sequence: PVFAGANYAAWAVNVAQVI (SEQ ID NO:115). In some cases, a suitable heterologous polypeptide comprising a diphtheria toxin T-cell epitope comprises the amino acid sequence: VHHNTEEIVAQSIALSSLMV (SEQ ID NO:116). In some cases, a suitable heterologous polypeptide comprising a diphtheria toxin T-cell epitope comprises the amino acid sequence: QSIALSSLMVAQAIPLVGEL (SEQ ID NO:117). In some cases, a suitable heterologous polypeptide comprising a diphtheria toxin T-cell epitope comprises the amino acid sequence: VDIGFAAYNFVESIINLFQV (SEQ ID NO:118). In some cases, a suitable heterologous polypeptide comprising a diphtheria toxin T-cell epitope comprises the amino acid sequence: QGESGHDIKITAENTPLPIA (SEQ ID NO:119). In some cases, a suitable heterologous polypeptide comprising a diphtheria toxin T-cell epitope comprises the amino acid sequence: GVLLPTIPGKLDVNKSKTHI (SEQ ID NO:120). In some cases, a suitable heterologous polypeptide comprising a diphtheria toxin T-cell epitope comprises the amino acid sequence of CRM197 (see, e.g., Giannini et al. (1984) *Nucl. Acids. Res.* 12:4063).

The amino acid sequence of CRM197 is as follows:

```
                                                  (SEQ ID NO: 121)
laddvvdssksfvmenfssyhgtkpgyvdsiqkgiqkpksgtqgnydddw
kefystdnkydaagysvdnenplsgkaggvvkvtypgltkvlalkvdnae
tikkelglslteplmeqvgteefikrfgdgasrvvlslpfaegsssveyi
nnweqakalsveleinfetrgkrgqdamyeymaqacagnrvrrsvgssls
cinldwdvirdktktkieslkehgpiknkmsespnktvseekakqyleef
hqtalehpelselktvtgtnpvfaganyaawavnvaqvidsetadnlekt
taalsilpgigsvmgiadgavhhnteeivaqsialsslmvaqaiplvgel
vdigfaaynfvesiinlfqvvhnsynrpayspghktqpflhdgyavswnt
vedsiirtgfqgesghdikitaentplpiagvllptipgkldvnkskthi
svngrkirmrcraidgdvtfcrpkspvyvgngvhanlhvafhrsssekih
sneissdsigvlgyqktvdhtkvnsklslffeiks.
```

In some cases, a heterologous polypeptide can comprise a tetanus toxin T-cell epitope and a diphtheria toxin T-cell epitope. In some of these cases, the heterologous polypeptide can comprise the amino acid sequence: IMQYIKANSKFIGIQSIALSSLMVAQ (SEQ ID NO:122); and can have a length of from 26 amino acids to 30 amino acids.

Mixtures of Heterologous Polypeptides (T-Cell Epitope Polypeptides)

In some cases, an immunogenic composition of the present disclosure comprises two or more different heterologous polypeptides comprising a T-cell epitope present in an HCV protein other than E1 and E2 (e.g., a mixture of two or more different heterologous polypeptides comprising a T-cell epitope present in an HCV protein other than E1 and E2).

For example, in some cases, an immunogenic composition of the present disclosure comprises: a) an HCV E1/E2 heterodimeric polypeptide; b) two or more different heterologous polypeptides comprising a T-cell epitope present in an HCV protein other than E1 and E2; and c) a pharmaceutically acceptable excipient. In some cases, an immunogenic composition of the present disclosure comprises: a) an HCV E2 polypeptide; b) two or more different heterologous polypeptides comprising a T-cell epitope present in an HCV protein other than E1 and E2; and c) a pharmaceutically acceptable excipient.

For example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP50, and having a length of from 50 amino acids to 55 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP52, and having a length of from 52 amino acids to 60 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP70, and having a length of from 70 amino acids to 75 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP100, and having a length of from 100 amino acids to 110 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP171, and having a length of from 171 amino acids to 180 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP228, and having a length of from 228 amino acids to 235 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP553, and having a length of from 553 amino acids to 565 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP778, and having a length of from 778 amino acids to 785 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP50, and having a length of from 50 amino acids to 55 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP52 and having a length of from 52 amino acids to 60 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP50, and having a length of from 50 amino acids to 55 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP70 and having a length of from 70 amino acids to 80 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP50, and having a length of from 50 amino acids to 55 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP100 and having a length of from 100 amino acids to 110 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP50, and having a length of from 50 amino acids to 55 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP171 and having a length of from 171 amino acids to 180 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP50, and having a length of from 50 amino acids to 55 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP228 and having a length of from 228 amino acids to 240 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP50, and having a length of from 50 amino acids to 55 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP553 and having a length of from 553 amino acids to 570 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP50, and having a length of from 50 amino acids to 55 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP778 and having a length of from 778 amino acids to 790 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP52, and having a length of from 52 amino acids to 60 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP70 and having a length of from 70 amino acids to 80 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP52, and having a length of from 52 amino acids to 60 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP100 and having a length of from 100 amino acids to 110 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP52, and having a length of from 52 amino acids to 60 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP171 and having a length of from 171 amino acids to 180 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP52, and having a length of from 52 amino acids to 60 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP228 and having a length of from 228 amino acids to 240 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP52, and having a length of from 52 amino acids to 60 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP553 and having a length of from 553 amino acids to 570 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP52, and having a length of from 52 amino acids to 60 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP778 and having a length of from 778 amino acids to 790 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP70, and having a length of from 70 amino acids to 80 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP100 and having a length of from 100 amino acids to 110 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP70, and having a length of from 70 amino acids to 80 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP171 and having a length of from 171 amino acids to 190 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP70, and having a length of from 70 amino acids to 80 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP228 and having a length of from 228 amino acids to 240 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP70, and having a length of from 70 amino acids to 80 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP553 and having a length of from 553 amino acids to 570 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP70, and having a length of from 70 amino acids to 80 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP778 and having a length of from 778 amino acids to 790 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP1985 and having a length of from 1985 amino acids to 2000 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP50, and having a length of from 50 amino acids to 55 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP1985 and having a length of from 1985 amino acids to 2000 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP52, and having a length of from 52 amino acids to 60 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP1985 and having a length of from 1985 amino acids to 2000 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP70, and having a length of from 70 amino acids to 80 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP1985 and having a length of from 1985 amino acids to 2000 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP100, and having a length of from 100 amino acids to 115 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP1985 and having a length of from 1985 amino acids to 2000 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP171, and having a length of from 171 amino acids to 180 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP1985 and having a length of from 1985 amino acids to 2000 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP228, and having a length of from 228 amino acids to 235 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP1985 and having a length of from 1985 amino acids to 2000 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP553, and having a length of from 553 amino acids to 560 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP1985 and having a length of from 1985 amino acids to 2000 amino acids.

As another example, the two or more different heterologous polypeptides can include: i) a first heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP778, and having a length of from 778 amino acids to 790 amino acids; and ii) a second heterologous polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP1985 and having a length of from 1985 amino acids to 2000 amino acids.

Pharmaceutically Acceptable Excipients

The present disclosure provides an immunogenic composition comprising: a) an HCV heterodimeric polypeptide comprising: i) an HCV E1 polypeptide; and ii) an HCV E2 polypeptide; b) a heterologous polypeptide comprising a T-cell epitope present in an HCV protein other than E1 and E2; and c) a pharmaceutically acceptable carrier. The present disclosure provides an immunogenic composition comprising: a) an HCV E2 polypeptide; b) a heterologous polypeptide comprising a T-cell epitope present in an HCV protein other than E1 and E2; and c) a pharmaceutically acceptable carrier. The present disclosure provides an immunogenic composition comprising: a) an HCV E1 polypeptide; b) a heterologous polypeptide comprising a T-cell epitope present in an HCV protein other than E1 and E2; and c) a pharmaceutically acceptable carrier.

In some cases, where an immunogenic composition of the present disclosure includes an HCV E1 polypeptide and an HCV E2 polypeptide, the ratio of HCV E2 polypeptide to HCV E1 polypeptide is in a range of from about 2:1 to 1:1, e.g., from about 2:1 to 1.5:1, or from 1.5:1 to 1:1. In some cases, where an immunogenic composition of the present disclosure includes an HCV E1 polypeptide and a HCV E2 polypeptide, the molar ratio of HCV E2 polypeptide to HCV E1 polypeptide is in a range of from about 1:1 to 1.5:1, from 1.5:1 to 2:1, from 2:1 to 3:1, from 3:1 to 4:1, from 4:1 to 6:1, or from 6:1 to 8:1.

HCV E1 polypeptides, HCV E2 polypeptides, and heterologous polypeptides can be formulated with a pharmaceutically acceptable excipient(s) to generate an immunogenic composition of the present disclosure. A wide variety of pharmaceutically acceptable excipients is known in the art and need not be discussed in detail herein. Pharmaceutically acceptable excipients have been amply described in a variety of publications, including, for example, A. Gennaro (2000) "Remington: The Science and Practice of Pharmacy", 20th edition, Lippincott, Williams, & Wilkins; Pharmaceutical Dosage Forms and Drug Delivery Systems (1999) H. C. Ansel et al., eds 7th ed., Lippincott, Williams, & Wilkins; and Handbook of Pharmaceutical Excipients (2000) A. H. Kibbe et al., eds., 3rd ed. Amer. Pharmaceutical Assoc.

In some embodiments, an HCV E1 polypeptide, an HCV E2 polypeptide (e.g., as an HCV E1/E2 heterodimer), and a heterologous polypeptide are formulated in an aqueous buffer. Suitable aqueous buffers include, but are not limited to, acetate, succinate, citrate, and phosphate buffers varying in strengths from about 5 mM to about 100 mM. In some embodiments, the aqueous buffer includes reagents that provide for an isotonic solution. Such reagents include, but are not limited to, sodium chloride; and sugars e.g., mannitol, dextrose, sucrose, and the like. In some embodiments, the aqueous buffer further includes a non-ionic surfactant such as polysorbate 20 (TWEEN®20) or polysorbate 80 (TWEEN®80). For example, a formulation of an HCV E1 polypeptide, an HCV E2 polypeptide (e.g., as an HCV E1/E2 heterodimer), and a heterologous polypeptide in an aqueous buffer can include, e.g., from about 0.01% to about 0.05% polysorbate-20 (TWEEN®20) non-ionic detergent. Optionally the formulations may further include a preservative. Suitable preservatives include, but are not limited to, a benzyl alcohol, phenol, chlorobutanol, benzalkonium chloride, and the like. In many cases, the formulation is stored at about 4° C. Formulations may also be lyophilized, in which case they generally include cryoprotectants such as sucrose, trehalose, lactose, maltose, mannitol, and the like. Lyophilized formulations can be stored over extended periods of time, even at ambient temperatures. In some cases, the aqueous buffer further includes a non-ionic surfactant. In some cases, the aqueous buffer includes the non-ionic surfactant Triton™X-100, e.g., 0.1% Triton™X-100.

An HCV E1 polypeptide, an HCV E2 polypeptide (e.g., as an HCV E1/E2 heterodimer), and a heterologous polypeptide can be formulated into preparations for injection by dissolving, suspending or emulsifying them in an aqueous or nonaqueous solvent, such as vegetable or other similar oils, synthetic aliphatic acid glycerides, esters of higher aliphatic acids or propylene glycol; and if desired, with conventional additives such as solubilizers, isotonic agents, suspending agents, emulsifying agents, stabilizers and preservatives.

An immunogenic composition of the present disclosure can include, e.g., pharmaceutical grades of mannitol, lactose, starch, magnesium stearate, sodium saccharin, talcum, cellulose, glucose, sucrose, magnesium, carbonate, and the like. The compositions may contain pharmaceutically acceptable auxiliary substances as required to approximate physiological conditions such as pH adjusting and buffering agents, toxicity adjusting agents and the like, for example, sodium acetate, sodium chloride, potassium chloride, calcium chloride, sodium lactate and the like.

The concentration of an HCV E1 polypeptide, an HCV E2 polypeptide (e.g., as an HCV E1/E2 heterodimer), and a heterologous polypeptide in a formulation can vary widely (e.g., from less than about 0.1% to at least about 2%, to as much as 20% to 50% or more by weight) and can be selected primarily based on fluid volumes, viscosities, and patient-based factors in accordance with the particular mode of administration selected and the patient's needs.

An immunogenic composition of the present disclosure can be provided in the form of a solution, suspension, tablet, pill, capsule, powder, gel, cream, lotion, ointment, aerosol or the like. It is recognized that oral administration can require protection of the compositions from digestion. This is typically accomplished either by association of the composition with an agent that renders it resistant to acidic and enzymatic hydrolysis or by packaging the composition in an appropriately resistant carrier. Means of protecting from digestion are well known in the art.

An immunogenic composition of the present disclosure can also be provided so as to enhance serum half-life of the polypeptides (an HCV E1 polypeptide, an HCV E2 polypeptide (e.g., as an HCV E1/E2 heterodimer), and a heterologous polypeptide) following administration. For example, where an isolated HCV E1 polypeptide, an HCV E2 polypeptide (e.g., as an HCV E1/E2 heterodimer), and a heterologous polypeptide are formulated for injection, the polypeptides may be provided in a liposome formulation, prepared as a colloid, or other conventional techniques for extending serum half-life. A variety of methods are available for preparing liposomes, as described in, e.g., Szoka et al., Ann Rev. Biophys. Bioeng. 9:467 (1980), U.S. Pat. Nos. 4,235,871, 4,501,728 and 4,837,028. The preparations may also be provided in controlled release or slow-release forms.

Adjuvant

An immunogenic composition of the present disclosure can include an adjuvant. Examples of known suitable adjuvants that can be used in humans include, but are not necessarily limited to, alum, aluminum phosphate, aluminum hydroxide, MF59™ (4.3% w/v squalene, 0.5% w/v Tween 80™ (polysorbate 80), 0.5% w/v Sorbitan trioleate (Span® 85)), CpG-containing nucleic acid (where the cytosine is unmethylated), QS21, monophosphoryl lipid A (MPL), 3-Q-desacyl-4'-monophosphoryl lipid A (3DMPL), extracts from Aquilla, immune-stimulating complexes (ISCOMS; complexes of cholesterol, phospholipids, and *Quillaia saponins*), LT/CT mutants, poly(D,L-lactide-co-glycolide) (PLG) microparticles, saponin vaccine adjuvant (Quil A®), interleukins, and the like. For experimental animals, one can use Freund's incomplete adjuvant, or Freund's complete adjuvant. Also suitable for use are N-acetyl-muramyl-L-threonyl-D-isoglutamine (thr-MDP), N-acetyl-nor-muramyl-L-alanyl-D-isoglutamine (CGP 11637, referred to as nor-MDP), N-acetylmuramyl-L-alanyl-D-isoglutaminyl-L-alanine-2-(1'-2'-dipalmitoyl-sn-glycero-3-hydroxyphosphoryloxy)-ethylamine (CGP 19835A, referred to as MTP-PE), and RIBI™, which contains three components extracted from bacteria: monophosphoryl lipid A, trehalose dimycolate and cell wall skeleton (MPL+TDM+CWS) in a 2% squalene Tween 80™ (polysorbate 80) emulsion. The effectiveness of an adjuvant may be determined by one or more of measuring the amount of antibodies directed against the immunogenic antigen or antigenic epitope thereof, measuring a cytotoxic T lymphocyte response to the antigen, and measuring a helper T cell response to the antigen.

Further exemplary adjuvants to enhance effectiveness of the composition include, but are not limited to: (1) oil-in-water emulsion formulations (with or without other specific immunostimulating agents such as muramyl peptides (see below) or bacterial cell wall components), such as for example (a) MF59™ (see, e.g., WO 90/14837), containing 5% Squalene, 0.5% Tween 80™ (polysorbate 80), and 0.5% Sorbitan trioleate (Span® 85) (optionally containing MTP-PE) formulated into submicron particles using a microfluidizer, (b) SAF, containing 10% Squalane, 0.4% Tween 80™ (polysorbate 80), 5% pluronic-blocked polymer L121, and thr-MDP either microfluidized into a submicron emulsion or vortexed to generate a larger particle size emulsion, and (c) RIBI™ adjuvant system (RAS), (Ribi Immunochem, Hamilton, Mont.) containing 2% Squalene, 0.2% Tween 80™ (polysorbate 80), and one or more bacterial cell wall components such as monophosphorylipid A (MPL), trehalose dimycolate (TDM), and cell wall skeleton (CWS), e.g., MPL+CWS (Detox™); (2) saponin adjuvants, such as QS21 or Stimulon™ (Cambridge Bioscience, Worcester, Mass.; a purified extract of *Quillaja saponaria*) may be used or particles generated therefrom such as ISCOMs (immunostimulating complexes), which ISCOMS may be devoid of additional detergent e.g. WO 00/07621; (3) Complete Freund's Adjuvant (CFA) and Incomplete Freund's Adjuvant (IFA); (4) cytokines, such as interleukins (e.g. IL-1, IL-2, IL-4, IL-5, IL-6, IL-7, IL-12 (WO99/44636), etc.), interferons (e.g. gamma interferon), macrophage colony stimulating factor (M-CSF), tumor necrosis factor (TNF), etc.; (5) monophosphoryl lipid A (MPL) or 3-O-deacylated MPL (3dMPL) e.g. GB-2220221, EP-A-0689454, optionally in the substantial absence of alum when used with pneumococcal saccharides e.g. WO 00/56358; (6) combinations of 3dMPL with, for example, QS21 and/or oil-in-water emulsions (see, e.g. EP-A-0835318, EP-A-0735898, EP-A-

0761231); (7) oligonucleotides comprising a CpG motif containing at least one CG dinucleotide, where the cytosine is unmethylated (see, e.g., WO 96/02555, WO 98/16247, WO 98/18810, WO 98/40100, WO 98/55495, WO 98/37919 and WO 98/52581); (8) a polyoxyethylene ether or a polyoxyethylene ester (see, e.g. WO 99/52549); (9) a polyoxyethylene sorbitan ester surfactant in combination with an octoxynol (WO 01/21207) or a polyoxyethylene alkyl ether or ester surfactant in combination with at least one additional non-ionic surfactant such as an octoxynol (WO 01/21152); (10) a saponin and an immunostimulatory oligonucleotide (e.g. a CpG oligonucleotide) (WO 00/62800); (11) an immunostimulant and a particle of metal salt (see, e.g. WO 00/23105); (12) a saponin and an oil-in-water emulsion (see e.g. WO 99/11241); (13) a saponin (e.g. QS21)+3dMPL+IM2 (optionally including a sterol) (see, e.g. WO 98/57659); (14) other substances that act as immunostimulating agents to enhance the efficacy of the composition. Muramyl peptides include N-acetyl-muramyl-L-threonyl-D-isoglutamine (thr-MDP), N-25 acetyl-normuramyl-L-alanyl-D-isoglutamine (nor-MDP), N-acetylmuramyl-L-alanyl-D-isoglutarninyl-L-alanine-2-(1'-2'-dipalmitoyl-sn-glycero-3-hydroxyphosphoryloxy)-ethylamine MTP-PE), etc. Also suitable for use is Matrix-M™; Matrix-M™ is an adjuvant that comprises 40 nm nanoparticles comprising *Quillaja* saponins, cholesterol, and phospholipid. Adjuvants suitable for administration to a human are of particular interest. In some cases, the adjuvant is one that enhances a $CD4^+$ T helper response to the immunogen. Also suitable for use is a poly inosine:cytosine (poly I:C) nucleic acid. Poly I:C is a synthetic double-stranded RNA Also suitable for use is a cyclic dinucleotide activator of the STING pathway. Examples of suitable cyclic dinucleotide adjuvants include, but are not limited to: 1) bis-(3',5')-cyclic dimeric adenosine monophosphate (c-di-AMP); 2) bis-(3',5')-cyclic dimeric guanosine monophosphate (c-di-GMP); and bis-(3',5')-cyclic dimeric inosine monosphosphate (c-di-IMP).

In some instances, the adjuvant is MF59, with or without a CpG-containing oligonucleotide. In other instances, the adjuvant is alum, with or without a CpG-containing oligonucleotide. In other instances, the adjuvant is poly(D,L-lactide-co-glycolide), with or without a CpG-containing oligonucleotide. In other instances, the adjuvant is MPL, with or without a CpG-containing oligonucleotide. In some cases, the adjuvant is Matrix-M™, with or without a CpG-containing oligonucleotide. In some cases, the adjuvant is keyhole limpet hemocyanin. In some cases, the adjuvant is alum. In some cases, the adjuvant is aluminum phosphate. In some cases, the adjuvant is aluminum hydroxide. In some cases, the adjuvant is alum+MPL. In some cases, the adjuvant is MF59. In some cases, the adjuvant is alum+MF59. In some cases, the adjuvant is AS01. AS01 contains QS-21 Stimulon® adjuvant, MPL, and liposomes. In some cases, the adjuvant is AS03. A dose of S03 contains: 10.69 mg squalene; 11.86 mg DL-a-tocopherol; and 4.86 mg polysorbate-80. In some cases, the adjuvant is AS04. In some cases, the adjuvant is AS15. AS15 is a combination of QS-21 Stimulon® adjuvant, monophosphoryl lipid A, and CpG7909 (an oligonucleotide of the sequence 5'-TCGTCGTTTTGTCGTTTTGTCGTT-3'; (SEQ ID NO:123), in a liposomal formulation.

Exemplary Compositions

The following are non-limiting examples of immunogenic compositions of the present disclosure.

1) In some cases, an immunogenic composition of the present disclosure comprises: a) an HCV E1/E2 heterodimer comprising: i) an HCV E1 polypeptide; and ii) a modified HCV E2 polypeptide comprising a Gly-Pro dipeptide appended to the N-terminus of an HCV E2 polypeptide (i.e., where the modified HCV E2 polypeptide is a Gly-Pro-E2 polypeptide); b) a polypeptide comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKL (SEQ ID NO:94); and having a length of from 29 amino acids (aa) to 35 aa (e.g., 29 aa, 30 aa, 31 aa, 32 aa, 33 aa, 34 aa, or 35 aa); and c) a pharmaceutically acceptable carrier. In some cases, the immunogenic composition comprises an adjuvant. In some instances, the adjuvant is MF59, with or without a CpG-containing oligonucleotide. In other instances, the adjuvant is alum, with or without a CpG-containing oligonucleotide. In other instances, the adjuvant is poly(D,L-lactide-co-glycolide), with or without a CpG-containing oligonucleotide. In other instances, the adjuvant is MPL, with or without a CpG-containing oligonucleotide. In some cases, the adjuvant is Matrix-M™, with or without a CpG-containing oligonucleotide. In some cases, the adjuvant is alum. In some cases, the adjuvant is MF59. In some cases, the adjuvant is alum+MF59. In some cases, the adjuvant is AS01. AS01 contains QS-21 Stimulon® adjuvant, MPL, and liposomes. In some cases, the adjuvant is AS03. A dose of S03 contains: 10.69 mg squalene; 11.86 mg DL-a-tocopherol; and 4.86 mg polysorbate-80. In some cases, the adjuvant is AS04. In some cases, the adjuvant is AS15. AS15 is a combination of QS-21 Stimulon® adjuvant, monophosphoryl lipid A, and CpG7909 (an oligonucleotide of the sequence 5'-TCGTCGTTTTGTCGTTTTGTCGTT-3'; SEQ ID NO:123), in a liposomal formulation. In some cases, an immunogenic composition of the present disclosure comprises: a) an HCV E1/E2 heterodimer comprising: i) an HCV E1 polypeptide; and ii) a modified HCV E2 polypeptide comprising a Gly-Pro dipeptide appended to the N-terminus of an HCV E2 polypeptide (i.e., where the modified HCV E2 polypeptide is a Gly-Pro-E2 polypeptide); b) a polypeptide comprising an amino acid sequence having at least 95%, at least about 98%, at least about 99%, or 100%, amino acid sequence identity to the following amino acid sequence: AIPLEVIKGGRHLIFCHSKKKCDELAAKL (SEQ ID NO:94); and having a length of 29 amino acids; and c) a pharmaceutically acceptable carrier. In some cases, the immunogenic composition comprises an adjuvant. In some instances, the adjuvant comprises MF59, alum, AS01, AS03, AS04, AS15, MPL, QS-21, or a CpG-containing oligonucleotide (e.g., CpG7909), or a combination of two of the foregoing. In some instances, the adjuvant comprises MF59. In some instances, the adjuvant comprises alum. In some instances, the adjuvant comprises alum+MPL. In some instances, the adjuvant comprises QS-21. In some cases, the immunogenic composition comprises a mixture of HCV E1/E2 heterodimers from different HCV genotypes. In some cases, the immunogenic composition comprises a mixture of HCV E1/E2 of genotype 1 and HCV E1/E2 of genotype 3. In some cases, the immunogenic composition comprises a mixture of HCV E1/E2 of genotype 1, HCV E1/E2 of genotype 2, and HCV E1/E2 of genotype 3.

2) In some cases, an immunogenic composition of the present disclosure comprises: a) an HCV E1/E2 heterodimer comprising: i) an HCV E1 polypeptide; and ii) a modified HCV E2 polypeptide comprising a Gly-Ser dipeptide appended to the N-terminus of an HCV E2 polypeptide (i.e., where the modified HCV E2 polypeptide is a Gly-Ser-E2 polypeptide); b) a polypeptide comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKL (SEQ ID NO:94); and having a length of from 29 amino acids (aa) to 35 aa (e.g., 29 aa, 30 aa, 31 aa, 32 aa, 33 aa, 34 aa, or 35 aa); and c) a pharmaceutically acceptable carrier. In some cases, the immunogenic composition comprises an adjuvant. In some instances, the adjuvant is MF59, with or without a CpG-containing oligonucleotide. In other instances, the adjuvant is alum, with or without a CpG-containing oligonucleotide. In other instances, the adjuvant is poly(D,L-lactide-co-glycolide), with or without a CpG-containing oligonucleotide. In other instances, the adjuvant is MPL, with or without a CpG-containing oligonucleotide. In some cases, the adjuvant is Matrix-M™, with or without a CpG-containing oligonucleotide. In some cases, the adjuvant is alum. In some cases, the adjuvant is MF59. In some cases, the adjuvant is alum+MF59. In some cases, the adjuvant is AS01. AS01 contains QS-21 Stimulon® adjuvant, MPL, and liposomes. In some cases, the adjuvant is AS03. A dose of S03 contains: 10.69 mg squalene; 11.86 mg DL-a-tocopherol; and 4.86 mg polysorbate-80. In some cases, the adjuvant is AS04. In some cases, the adjuvant is AS15. AS15 is a combination of QS-21 Stimulon® adjuvant, monophosphoryl lipid A, and CpG7909 (an oligonucleotide of the sequence 5'-TCGTCGTTTTGTCGTTTTGTCGTT-3'; SEQ ID NO:123), in a liposomal formulation. In some cases, an immunogenic composition of the present disclosure comprises: a) an HCV E1/E2 heterodimer comprising: i) an HCV E1 polypeptide; and ii) a modified HCV E2 polypeptide comprising a Gly-Ser dipeptide appended to the N-terminus of an HCV E2 polypeptide (i.e., where the modified HCV E2 polypeptide is a Gly-Ser-E2 polypeptide); b) a polypeptide comprising an amino acid sequence having at least 95%, at least about 98%, at least about 99%, or 100%, amino acid sequence identity to the following amino acid sequence: AIPLEVIKGGRHLIFCHSKKKCDELAAKL (SEQ ID NO:94); and having a length of 29 amino acids; and c) a pharmaceutically acceptable carrier. In some cases, the immunogenic composition comprises an adjuvant. In some instances, the adjuvant comprises MF59, alum, AS01, AS03, AS04, AS15, MPL, QS-21, or a CpG-containing oligonucleotide (e.g., CpG7909), or a combination of two of the foregoing. In some instances, the adjuvant comprises MF59. In some instances, the adjuvant comprises alum. In some instances, the adjuvant comprises alum+MPL. In some instances, the adjuvant comprises QS-21. In some cases, the immunogenic composition comprises a mixture of HCV E1/E2 heterodimers from different HCV genotypes. In some cases, the immunogenic composition comprises a mixture of HCV E1/E2 of genotype 1 and HCV E1/E2 of genotype 3. In some cases, the immunogenic composition comprises a mixture of HCV E1/E2 of genotype 1, HCV E1/E2 of genotype 2, and HCV E1/E2 of genotype 3.

3) In some cases, an immunogenic composition of the present disclosure comprises: a) an HCV E1/E2 heterodimer comprising: i) an HCV E1 polypeptide; and ii) a modified HCV E2 polypeptide comprising a Gly-Pro dipeptide appended to the N-terminus of an HCV E2 polypeptide (i.e., where the modified HCV E2 polypeptide is a Gly-Pro-E2 polypeptide); b) a polypeptide that comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRDWAHNGLRDLAVAVE-PVVFSQMETKLITWGADT (SEQ ID NO:99); and that has a length of from 50 amino acids to 60 amino acids (e.g., 50 aa, 51 aa, 52 aa, 53 aa, 54 aa, 55 aa, 56 aa, 57 aa, 58 aa, 59 aa, or 60 aa); and c) a pharmaceutically acceptable carrier. In some cases, the immunogenic composition comprises an adjuvant. In some instances, the adjuvant is MF59, with or without a CpG-containing oligonucleotide. In other instances, the adjuvant is alum, with or without a CpG-containing oligonucleotide. In other instances, the adjuvant is poly(D,L-lactide-co-glycolide), with or without a CpG-containing oligonucleotide. In other instances, the adjuvant is MPL, with or without a CpG-containing oligonucleotide. In some cases, the adjuvant is Matrix-M™, with or without a CpG-containing oligonucleotide. In some cases, the adjuvant is alum. In some cases, the adjuvant is MF59. In some cases, the adjuvant is alum+MF59. In some cases, the adjuvant is AS01. AS01 contains QS-21 Stimulon® adjuvant, MPL, and liposomes. In some cases, the adjuvant is AS03. A dose of S03 contains: 10.69 mg squalene; 11.86 mg DL-a-tocopherol; and 4.86 mg polysorbate-80. In some cases, the adjuvant is AS04. In some cases, the adjuvant is AS15. AS15 is a combination of QS-21 Stimulon® adjuvant, monophosphoryl lipid A, and CpG7909 (an oligonucleotide of the sequence 5'-TCGTCGTTTTGTCGTTTTGTCGTT-3'; SEQ ID NO:123), in a liposomal formulation. In some cases, an immunogenic composition of the present disclosure comprises: a) an HCV E1/E2 heterodimer comprising: i) an HCV E1 polypeptide; and ii) a modified HCV E2 polypeptide comprising a Gly-Pro dipeptide appended to the N-terminus of an HCV E2 polypeptide (i.e., where the modified HCV E2 polypeptide is a Gly-Pro-E2 polypeptide); b) a polypeptide comprising an amino acid sequence having at least 95%, at least about 98%, at least about 99%, or 100%, amino acid sequence identity to the following amino acid sequence: LGALTGTYVYNHLTPLRDWAHNGLRDLAVAVE-PVVFSQMETKLITWGADT (SEQ ID NO:99); and having a length of 50 amino acids; and c) a pharmaceutically acceptable carrier. In some cases, the immunogenic composition comprises an adjuvant. In some instances, the adjuvant comprises MF59, alum, AS01, AS03, AS04, AS15, MPL, QS-21, or a CpG-containing oligonucleotide (e.g., CpG7909), or a combination of two of the foregoing. In some instances, the adjuvant comprises MF59. In some instances, the adjuvant comprises alum. In some instances, the adjuvant comprises alum+MPL. In some instances, the adjuvant comprises QS-21. In some cases, the immunogenic composition comprises a mixture of HCV E1/E2 heterodimers from different HCV genotypes. In some cases, the immunogenic composition comprises a mixture of HCV E1/E2 of genotype 1 and HCV E1/E2 of genotype 3. In some cases, the immunogenic composition comprises a mixture of HCV E1/E2 of genotype 1, HCV E1/E2 of genotype 2, and HCV E1/E2 of genotype 3.

4) In some cases, an immunogenic composition of the present disclosure comprises: a) an HCV E1/E2 heterodimer comprising: i) an HCV E1 polypeptide; and ii) a modified HCV E2 polypeptide comprising a Gly-Ser dipeptide appended to the N-terminus of an HCV E2 polypeptide (i.e., where the modified HCV E2 polypeptide is a Gly-Ser-E2 polypeptide); b) a polypeptide that comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRDWAHNGLRDLAVAVE-PVVFSQMETKLITWGADT (SEQ ID NO:99); and that has a length of from 50 amino acids to 60 amino acids (e.g., 50 aa, 51 aa, 52 aa, 53 aa, 54 aa, 55 aa, 56 aa, 57 aa, 58 aa, 59 aa, or 60 aa); and c) a pharmaceutically acceptable carrier. In some cases, the immunogenic composition comprises an adjuvant. In some instances, the adjuvant is MF59, with or without a CpG-containing oligonucleotide. In other instances, the adjuvant is alum, with or without a CpG-containing oligonucleotide. In other instances, the adjuvant is poly(D,L-lactide-co-glycolide), with or without a CpG-containing oligonucleotide. In other instances, the adjuvant is MPL, with or without a CpG-containing oligonucleotide. In some cases, the adjuvant is Matrix-M™, with or without a CpG-containing oligonucleotide. In some cases, the adjuvant is alum. In some cases, the adjuvant is MF59. In some cases, the adjuvant is alum+MF59. In some cases, the adjuvant is AS01. AS01 contains QS-21 Stimulon® adjuvant, MPL, and liposomes. In some cases, the adjuvant is AS03. A dose of S03 contains: 10.69 mg squalene; 11.86 mg DL-a-tocopherol; and 4.86 mg polysorbate-80. In some cases, the adjuvant is AS04. In some cases, the adjuvant is AS15. AS15 is a combination of QS-21 Stimulon® adjuvant, monophosphoryl lipid A, and CpG7909 (an oligonucleotide of the sequence 5'-TCGTCGTTTTGTCGTTTTGTCGTT-3'; SEQ ID NO:123), in a liposomal formulation. In some cases, an immunogenic composition of the present disclosure comprises: a) an HCV E1/E2 heterodimer comprising: i) an HCV E1 polypeptide; and ii) a modified HCV E2 polypeptide comprising a Gly-Ser dipeptide appended to the N-terminus of an HCV E2 polypeptide (i.e., where the modified HCV E2 polypeptide is a Gly-Ser-E2 polypeptide); b) a polypeptide comprising an amino acid sequence having at least 95%, at least about 98%, at least about 99%, or 100%, amino acid sequence identity to the following amino acid sequence: LGALTGTYVYNHLTPLRDWAHNGLRDLAVAVE-PVVFSQMETKLITWGADT (SEQ ID NO:99); and having a length of 50 amino acids; and c) a pharmaceutically acceptable carrier. In some cases, the immunogenic composition comprises an adjuvant. In some instances, the adjuvant comprises MF59, alum, AS01, AS03, AS04, AS15, MPL, QS-21, or a CpG-containing oligonucleotide (e.g., CpG7909), or a combination of two of the foregoing. In some instances, the adjuvant comprises MF59. In some instances, the adjuvant comprises alum. In some instances, the adjuvant comprises alum+MPL. In some instances, the adjuvant comprises QS-21. In some cases, the immunogenic composition comprises a mixture of HCV E1/E2 heterodimers from different HCV genotypes. In some cases, the immunogenic composition comprises a mixture of HCV E1/E2 of genotype 1 and HCV E1/E2 of genotype 3. In some cases, the immunogenic composition comprises a mixture of HCV E1/E2 of genotype 1, HCV E1/E2 of genotype 2, and HCV E1/E2 of genotype 3.

5) In some cases, an immunogenic composition of the present disclosure comprises: a) an HCV E1/E2 heterodimer comprising: i) an HCV E1 polypeptide; and ii) a modified HCV E2 polypeptide comprising a Gly-Pro dipeptide appended to the N-terminus of an HCV E2 polypeptide (i.e., where the modified HCV E2 polypeptide is a Gly-Pro-E2 polypeptide); b) a polypeptide that comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKLVALGI-NAVAYYRGLDVSVIPTSG (SEQ ID NO:95); and that has a length of from 52 amino acids to 60 amino acids (e.g., 52 aa, 53 aa, 54 aa, 55 aa, 56 aa, 57 aa, 58 aa, 59 aa, or 60 aa); and c) a pharmaceutically acceptable carrier. In some cases, the immunogenic composition comprises an adjuvant. In some instances, the adjuvant is MF59, with or without a CpG-containing oligonucleotide. In other instances, the adjuvant is alum, with or without a CpG-containing oligonucleotide. In other instances, the adjuvant is poly(D,L-lactide-co-glycolide), with or without a CpG-containing oligonucleotide. In other instances, the adjuvant is MPL, with or without a CpG-containing oligonucleotide. In some cases, the adjuvant is Matrix-M™, with or without a CpG-containing oligonucleotide. In some cases, the adjuvant is alum. In some cases, the adjuvant is MF59. In some cases, the adjuvant is alum+MF59. In some cases, the adjuvant is AS01. AS01 contains QS-21 Stimulon® adjuvant, MPL, and liposomes. In some cases, the adjuvant is AS03. A dose of S03 contains: 10.69 mg squalene; 11.86 mg DL-a-tocopherol; and 4.86 mg polysorbate-80. In some cases, the adjuvant is AS04. In some cases, the adjuvant is AS15. AS15 is a combination of QS-21 Stimulon® adjuvant, monophosphoryl lipid A, and CpG7909 (an oligonucleotide of the sequence 5'-TCGTCGTTTTGTCGTTTTGTCGTT-3'; SEQ ID NO:123), in a liposomal formulation. In some cases, an immunogenic composition of the present disclosure comprises: a) an HCV E1/E2 heterodimer comprising: i) an HCV E1 polypeptide; and ii) a modified HCV E2 polypeptide comprising a Gly-Pro dipeptide appended to the N-terminus of an HCV E2 polypeptide (i.e., where the modified HCV E2 polypeptide is a Gly-Pro-E2 polypeptide); b) a polypeptide comprising an amino acid sequence having at least 95%, at least about 98%, at least about 99%, or 100%, amino acid sequence identity to the following amino acid sequence: AIPLEVIKGGRHLIFCHSKKKCDELAAKLVALGI-NAVAYYRGLDVSVIPTSG (SEQ ID NO:95); and having a length of 52 amino acids; and c) a pharmaceutically acceptable carrier. In some cases, the immunogenic composition comprises an adjuvant. In some instances, the adjuvant comprises MF59, alum, AS01, AS03, AS04, AS15, MPL, QS-21, or a CpG-containing oligonucleotide (e.g., CpG7909), or a combination of two of the foregoing. In some instances, the adjuvant comprises MF59. In some instances, the adjuvant comprises alum. In some instances, the adjuvant comprises alum+MPL. In some instances, the adjuvant comprises QS-21. In some cases, the immunogenic composition comprises a mixture of HCV E1/E2 heterodimers from different HCV genotypes. In some cases, the immunogenic composition comprises a mixture of HCV E1/E2 of genotype 1 and HCV E1/E2 of genotype 3. In some cases, the immunogenic composition comprises a mixture of HCV E1/E2 of genotype 1, HCV E1/E2 of genotype 2, and HCV E1/E2 of genotype 3.

6) In some cases, an immunogenic composition of the present disclosure comprises: a) an HCV E1/E2 heterodimer comprising: i) an HCV E1 polypeptide; and ii) a modified HCV E2 polypeptide comprising a Gly-Ser dipeptide appended to the N-terminus of an HCV E2 polypeptide (i.e., where the modified HCV E2 polypeptide is a Gly-Ser-E2 polypeptide); b) a polypeptide that comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKLVALGI-NAVAYYRGLDVSVIPTSG (SEQ ID NO:95); and that has a length of from 52 amino acids to 60 amino acids (e.g., 52 aa, 53 aa, 54 aa, 55 aa, 56 aa, 57 aa, 58 aa, 59 aa, or 60 aa); and c) a pharmaceutically acceptable carrier. In some cases, the immunogenic composition comprises an adjuvant. In some instances, the adjuvant is MF59, with or without a CpG-containing oligonucleotide. In other instances, the adjuvant is alum, with or without a CpG-containing oligonucleotide. In other instances, the adjuvant is poly(D,L-lactide-co-glycolide), with or without a CpG-containing oligonucleotide. In other instances, the adjuvant is MPL, with or without a CpG-containing oligonucleotide. In some cases, the adjuvant is Matrix-M™, with or without a CpG-containing oligonucleotide. In some cases, the adjuvant is alum. In some cases, the adjuvant is MF59. In some cases, the adjuvant is alum+MF59. In some cases, the adjuvant is AS01. AS01 contains QS-21 Stimulon® adjuvant, MPL, and liposomes. In some cases, the adjuvant is AS03. A dose of S03 contains: 10.69 mg squalene; 11.86 mg DL-a-tocopherol; and 4.86 mg polysorbate-80. In some cases, the adjuvant is AS04. In some cases, the adjuvant is AS15. AS15 is a combination of QS-21 Stimulon® adjuvant, monophosphoryl lipid A, and CpG7909 (an oligonucleotide of the sequence 5'-TCGTCGTTTTGTCGTTTTGTCGTT-3'; SEQ ID NO:123), in a liposomal formulation. In some cases, an immunogenic composition of the present disclosure comprises: a) an HCV E1/E2 heterodimer comprising: i) an HCV E1 polypeptide; and ii) a modified HCV E2 polypeptide comprising a Gly-Ser dipeptide appended to the N-terminus of an HCV E2 polypeptide (i.e., where the modified HCV E2 polypeptide is a Gly-Ser-E2 polypeptide); b) a polypeptide comprising an amino acid sequence having at least 95%, at least about 98%, at least about 99%, or 100%, amino acid sequence identity to the following amino acid sequence: AIPLEVIKGGRHLIFCHSKKKCDELAAKLVALGI-NAVAYYRGLDVSVIPTSG (SEQ ID NO:95); and having a length of 52 amino acids; and c) a pharmaceutically acceptable carrier. In some cases, the immunogenic composition comprises an adjuvant. In some instances, the adjuvant comprises MF59, alum, AS01, AS03, AS04, AS15, MPL, QS-21, or a CpG-containing oligonucleotide (e.g., CpG7909), or a combination of two of the foregoing. In some instances, the adjuvant comprises MF59. In some instances, the adjuvant comprises alum. In some instances, the adjuvant comprises alum+MPL. In some instances, the adjuvant comprises QS-21. In some cases, the immunogenic composition comprises a mixture of HCV E1/E2 heterodimers from different HCV genotypes. In some cases, the immunogenic composition comprises a mixture of HCV E1/E2 of genotype 1 and HCV E1/E2 of genotype 3. In some cases, the immunogenic composition comprises a mixture of HCV E1/E2 of genotype 1, HCV E1/E2 of genotype 2, and HCV E1/E2 of genotype 3.

7) In some cases, an immunogenic composition of the present disclosure comprises: a) an HCV E1/E2 heterodimer comprising: i) an HCV E1 polypeptide; and ii) a modified HCV E2 polypeptide comprising a Gly-Pro dipeptide appended to the N-terminus of an HCV E2 polypeptide (i.e., where the modified HCV E2 polypeptide is a Gly-Pro-E2 polypeptide); b) a polypeptide that comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: KGGRHLIFCHSKKKCDELAAKLVALGINAVAYYR-GLDVSVIPTSGDVVVVATDALMTG FTGDFDSVIDCN (SEQ ID NO:96); and that has a length of from 70 amino acids to 80 amino acids (e.g., 70 aa, 71 aa, 72 aa, 73 aa, 74 aa, 75 aa, 76 aa, 77 aa, 78 aa, 79 aa, or 80 aa); and c) a pharmaceutically acceptable carrier. In some cases, the immunogenic composition comprises an adjuvant. In some instances, the adjuvant is MF59, with or without a CpG-containing oligonucleotide. In other instances, the adjuvant is alum, with or without a CpG-containing oligonucleotide. In other instances, the adjuvant is poly(D,L-lactide-co-glycolide), with or without a CpG-containing oligonucleotide. In other instances, the adjuvant is MPL, with or without a CpG-containing oligonucleotide. In some cases, the adjuvant is Matrix-M™, with or without a CpG-containing oligonucleotide. In some cases, the adjuvant is alum. In some cases, the adjuvant is MF59. In some cases, the adjuvant is alum+MF59. In some cases, the adjuvant is AS01. AS01 contains QS-21 Stimulon® adjuvant, MPL, and liposomes. In some cases, the adjuvant is AS03. A dose of S03 contains: 10.69 mg squalene; 11.86 mg DL-a-tocopherol; and 4.86 mg polysorbate-80. In some cases, the adjuvant is AS04. In some cases, the adjuvant is AS15. AS15 is a combination of QS-21 Stimulon® adjuvant, monophosphoryl lipid A, and CpG7909 (an oligonucleotide of the sequence 5'-TCGTCGTTTTGTCGTTTTGTCGTT-3'; SEQ ID NO:123), in a liposomal formulation. In some cases, an immunogenic composition of the present disclosure comprises: a) an HCV E1/E2 heterodimer comprising: i) an HCV E1 polypeptide; and ii) a modified HCV E2 polypeptide comprising a Gly-Pro dipeptide appended to the N-terminus of an HCV E2 polypeptide (i.e., where the modified HCV E2 polypeptide is a Gly-Pro-E2 polypeptide); b) a polypeptide comprising an amino acid sequence having at least 95%, at least about 98%, at least about 99%, or 100%, amino acid sequence identity to the following amino acid sequence: KGGRHLIFCHSKKKCDELAAKLVALGINAVAYYR-GLDVSVIPTSGDVVVVATDALMTG FTGDFDSVIDCN (SEQ ID NO:96); and having a length of 70 amino acids; and c) a pharmaceutically acceptable carrier. In some cases, the immunogenic composition comprises an adjuvant. In some instances, the adjuvant comprises MF59, alum, AS01, AS03, AS04, AS15, MPL, QS-21, or a CpG-containing oligonucleotide (e.g., CpG7909), or a combination of two of the foregoing. In some instances, the adjuvant comprises MF59. In some instances, the adjuvant comprises alum. In some instances, the adjuvant comprises alum+MPL. In some instances, the adjuvant comprises QS-21. In some cases, the immunogenic composition comprises a mixture of HCV E1/E2 heterodimers from different HCV genotypes. In some cases, the immunogenic composition comprises a mixture of HCV E1/E2 of genotype 1 and HCV E1/E2 of genotype 3. In some cases, the immunogenic composition comprises a mixture of HCV E1/E2 of genotype 1, HCV E1/E2 of genotype 2, and HCV E1/E2 of genotype 3.

8) In some cases, an immunogenic composition of the present disclosure comprises: a) an HCV E1/E2 heterodimer comprising: i) an HCV E1 polypeptide; and ii) a modified HCV E2 polypeptide comprising a Gly-Ser dipeptide appended to the N-terminus of an HCV E2 polypeptide (i.e., where the modified HCV E2 polypeptide is a Gly-Ser-E2 polypeptide); b) a polypeptide that comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: KGGRHLIFCHSKKKCDELAAKLVALGINAVAYYR-GLDVSVIPTSGDVVVVATDALMTG FTGDFDSVIDCN (SEQ ID NO:96); and that has a length of from 70 amino acids to 80 amino acids (e.g., 70 aa, 71 aa, 72 aa, 73 aa, 74 aa, 75 aa, 76 aa, 77 aa, 78 aa, 79 aa, or 80 aa); and c) a pharmaceutically acceptable carrier. In some cases, the immunogenic composition comprises an adjuvant. In some instances, the adjuvant is MF59, with or without a CpG-containing oligonucleotide. In other instances, the adjuvant is alum, with or without a CpG-containing oligonucleotide. In other instances, the adjuvant is poly(D,L-lactide-co-glycolide), with or without a CpG-containing oligonucleotide. In other instances, the adjuvant is MPL, with or without a CpG-containing oligonucleotide. In some cases, the adjuvant is Matrix-M™, with or without a CpG-containing oligonucleotide. In some cases, the adjuvant is alum. In some cases, the adjuvant is MF59. In some cases, the adjuvant is alum+MF59. In some cases, the adjuvant is AS01. AS01 contains QS-21 Stimulon® adjuvant, MPL, and liposomes. In some cases, the adjuvant is AS03. A dose of S03 contains: 10.69 mg squalene; 11.86 mg DL-a-tocopherol; and 4.86 mg polysorbate-80. In some cases, the adjuvant is AS04. In some cases, the adjuvant is AS15. AS15 is a combination of QS-21 Stimulon® adjuvant, monophosphoryl lipid A, and CpG7909 (an oligonucleotide of the sequence 5'-TCGTCGTTTTGTCGTTTTGTCGTT-3'; SEQ ID NO:123), in a liposomal formulation. In some cases, an immunogenic composition of the present disclosure comprises: a) an HCV E1/E2 heterodimer comprising: i) an HCV E1 polypeptide; and ii) a modified HCV E2 polypeptide comprising a Gly-Ser dipeptide appended to the N-terminus of an HCV E2 polypeptide (i.e., where the modified HCV E2 polypeptide is a Gly-Ser-E2 polypeptide); b) a polypeptide comprising an amino acid sequence having at least 95%, at least about 98%, at least about 99%, or 100%, amino acid sequence identity to the following amino acid sequence: KGGRHLIFCHSKKKCDELAAKLVALGINAVAYYR-GLDVSVIPTSGDVVVVATDALMTG FTGDFDSVIDCN (SEQ ID NO:96); and having a length of 70 amino acids; and c) a pharmaceutically acceptable carrier. In some cases, the immunogenic composition comprises an adjuvant. In some instances, the adjuvant comprises MF59, alum, AS01, AS03, AS04, AS15, MPL, QS-21, or a CpG-containing oligonucleotide (e.g., CpG7909), or a combination of two of the foregoing. In some instances, the adjuvant comprises MF59. In some instances, the adjuvant comprises alum. In some instances, the adjuvant comprises alum+MPL. In some instances, the adjuvant comprises QS-21. In some cases, the immunogenic composition comprises a mixture of HCV E1/E2 heterodimers from different HCV genotypes. In some cases, the immunogenic composition comprises a mixture of HCV E1/E2 of genotype 1 and HCV E1/E2 of genotype 3. In some cases, the immunogenic composition comprises a mixture of HCV E1/E2 of genotype 1, HCV E1/E2 of genotype 2, and HCV E1/E2 of genotype 3.

9) In some cases, an immunogenic composition of the present disclosure comprises: a) an HCV E1/E2 heterodimer comprising: i) an HCV E1 polypeptide; and ii) a modified HCV E2 polypeptide comprising a Gly-Pro dipeptide appended to the N-terminus of an HCV E2 polypeptide (i.e., where the modified HCV E2 polypeptide is a Gly-Pro-E2 polypeptide); b) a polypeptide that comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: VALSTTGEIPFYGKAIPLEVIKGGRHLIFCHS-KKKCDELAAKLVALGINAVAYYRGLDVS VIPTSGDVVV-VATDALMTGFTGDFDSVIDCNTCVTQTVDF (SEQ ID NO:97); and that has a length of from 100 amino acids (aa) to 110 aa (e.g., 100 aa, 101 aa, 102 aa, 103 aa, 104 aa, 105 aa, 106 aa, 107 aa, 108 aa, 109 aa, or 110 aa); and c) a pharmaceutically acceptable carrier. In some cases, the immunogenic composition comprises an adjuvant. In some instances, the adjuvant is MF59, with or without a CpG-containing oligonucleotide. In other instances, the adjuvant is alum, with or without a CpG-containing oligonucleotide. In other instances, the adjuvant is poly(D,L-lactide-co-glycolide), with or without a CpG-containing oligonucleotide. In other instances, the adjuvant is MPL, with or without a CpG-containing oligonucleotide. In some cases, the adjuvant is Matrix-M™, with or without a CpG-containing oligonucleotide. In some cases, the adjuvant is alum. In some cases, the adjuvant is MF59. In some cases, the adjuvant is alum+MF59. In some cases, the adjuvant is AS01. AS01 contains QS-21 Stimulon® adjuvant, MPL, and liposomes. In some cases, the adjuvant is AS03. A dose of S03 contains: 10.69 mg squalene; 11.86 mg DL-a-tocopherol; and 4.86 mg polysorbate-80. In some cases, the adjuvant is AS04. In some cases, the adjuvant is AS15. AS15 is a combination of QS-21 Stimulon® adjuvant, monophosphoryl lipid A, and CpG7909 (an oligonucleotide of the sequence 5'-TCGTCGTTTTGTCGTTTTGTCGTT-3'; SEQ ID NO:123), in a liposomal formulation. In some cases, an immunogenic composition of the present disclosure comprises: a) an HCV E1/E2 heterodimer comprising: i) an HCV E1 polypeptide; and ii) a modified HCV E2 polypeptide comprising a Gly-Pro dipeptide appended to the N-terminus of an HCV E2 polypeptide (i.e., where the modified HCV E2 polypeptide is a Gly-Pro-E2 polypeptide); b) a polypeptide comprising an amino acid sequence having at least 95%, at least about 98%, at least about 99%, or 100%, amino acid sequence identity to the following amino acid sequence: VALSTTGEIPFYGKAIPLEVIKGGRHLIFCHS-KKKCDELAAKLVALGINAVAYYRGLDVS VIPTSGDVVV-VATDALMTGFTGDFDSVIDCNTCVTQTVDF (SEQ ID NO:97); and having a length of 100 amino acids; and c) a pharmaceutically acceptable carrier. In some cases, the immunogenic composition comprises an adjuvant. In some instances, the adjuvant comprises MF59, alum, AS01, AS03, AS04, AS15, MPL, QS-21, or a CpG-containing oligonucleotide (e.g., CpG7909), or a combination of two of the foregoing. In some instances, the adjuvant comprises MF59. In some instances, the adjuvant comprises alum. In some instances, the adjuvant comprises alum+MPL. In some instances, the adjuvant comprises QS-21. In some cases, the immunogenic composition comprises a mixture of HCV E1/E2 heterodimers from different HCV genotypes. In some cases, the immunogenic composition comprises a mixture of HCV E1/E2 of genotype 1 and HCV E1/E2 of genotype 3. In some cases, the immunogenic composition comprises a mixture of HCV E1/E2 of genotype 1, HCV E1/E2 of genotype 2, and HCV E1/E2 of genotype 3.

10) In some cases, an immunogenic composition of the present disclosure comprises: a) an HCV E1/E2 heterodimer comprising: i) an HCV E1 polypeptide; and ii) a modified HCV E2 polypeptide comprising a Gly-Ser dipeptide appended to the N-terminus of an HCV E2 polypeptide (i.e., where the modified HCV E2 polypeptide is a Gly-Ser-E2 polypeptide); b) a polypeptide that comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: VALSTTGEIPFYGKAIPLEVIKGGRHLIFCHS-KKKCDELAAKLVALGINAVAYYRGLDVS VIPTSGDVVV-VATDALMTGFTGDFDSVIDCNTCVTQTVDF (SEQ ID NO:97); and that has a length of from 100 amino acids (aa) to 110 aa (e.g., 100 aa, 101 aa, 102 aa, 103 aa, 104 aa, 105 aa, 106 aa, 107 aa, 108 aa, 109 aa, or 110 aa); and c) a pharmaceutically acceptable carrier. In some cases, the immunogenic composition comprises an adjuvant. In some instances, the adjuvant is MF59, with or without a CpG-containing oligonucleotide. In other instances, the adjuvant is alum, with or without a CpG-containing oligonucleotide. In other instances, the adjuvant is poly(D,L-lactide-co-glycolide), with or without a CpG-containing oligonucleotide. In other instances, the adjuvant is MPL, with or without a CpG-containing oligonucleotide. In some cases, the adjuvant is Matrix-M™, with or without a CpG-containing oligonucleotide. In some cases, the adjuvant is alum. In some cases, the adjuvant is MF59. In some cases, the adjuvant is alum+MF59. In some cases, the adjuvant is AS01. AS01 contains QS-21 Stimulon® adjuvant, MPL, and liposomes. In some cases, the adjuvant is AS03. A dose of S03 contains: 10.69 mg squalene; 11.86 mg DL-a-tocopherol; and 4.86 mg polysorbate-80. In some cases, the adjuvant is AS04. In some cases, the adjuvant is AS15. AS15 is a combination of QS-21 Stimulon® adjuvant, monophosphoryl lipid A, and CpG7909 (an oligonucleotide of the sequence 5'-TCGTCGTTTTGTCGTTTTGTCGTT-3'; SEQ ID NO:123), in a liposomal formulation. In some cases, an immunogenic composition of the present disclosure comprises: a) an HCV E1/E2 heterodimer comprising: i) an HCV E1 polypeptide; and ii) a modified HCV E2 polypeptide comprising a Gly-Ser dipeptide appended to the N-terminus of an HCV E2 polypeptide (i.e., where the modified HCV E2 polypeptide is a Gly-Ser-E2 polypeptide); b) a polypeptide comprising an amino acid sequence having at least 95%, at least about 98%, at least about 99%, or 100%, amino acid sequence identity to the following amino acid sequence: VALSTTGEIPFYGKAIPLEVIKGGRHLIFCHS-KKKCDELAAKLVALGINAVAYYRGLDVS VIPTSGDVVV-VATDALMTGFTGDFDSVIDCNTCVTQTVDF (SEQ ID NO:97); and having a length of 100 amino acids; and c) a pharmaceutically acceptable carrier. In some cases, the immunogenic composition comprises an adjuvant. In some instances, the adjuvant comprises MF59, alum, AS01, AS03, AS04, AS15, MPL, QS-21, or a CpG-containing oligonucleotide (e.g., CpG7909), or a combination of two of the foregoing. In some instances, the adjuvant comprises MF59. In some instances, the adjuvant comprises alum. In some instances, the adjuvant comprises alum+MPL. In some instances, the adjuvant comprises QS-21. In some cases, the immunogenic composition comprises a mixture of HCV E1/E2 heterodimers from different HCV genotypes. In some cases, the immunogenic composition comprises a mixture of HCV E1/E2 of genotype 1 and HCV E1/E2 of genotype 3. In some cases, the immunogenic composition comprises a mixture of HCV E1/E2 of genotype 1, HCV E1/E2 of genotype 2, and HCV E1/E2 of genotype 3.

11) In some cases, an immunogenic composition of the present disclosure comprises: a) an HCV E1/E2 heterodimer comprising: i) an HCV E1 polypeptide; and ii) a modified HCV E2 polypeptide comprising a Gly-Pro dipeptide appended to the N-terminus of an HCV E2 polypeptide (i.e., where the modified HCV E2 polypeptide is a Gly-Pro-E2 polypeptide); b) a polypeptide that comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQI-VGGVYLLPRRGPRLGVRATRKTSERSQP RGRRQPIPKARRPEGRTWAQPGYPWPLYGNEGCG-WAGWLLSPRGSRPSWGPTDPRRRS RNLGKVIDTLTCGFADLMGYIPLVGAPLGGAARAL-AHGVRVLEDGVNYATGNLPG (SEQ ID NO:89); and can has a length of from 171 amino acids (aa) to 180 aa (e.g., 171 aa, 172 aa, 173 aa, 174 aa, 175 aa, 176 aa, 177 aa, 178 aa, 179 aa, or 180 aa); and c) a pharmaceutically acceptable carrier. In some cases, the immunogenic composition comprises an adjuvant. In some instances, the adjuvant is MF59, with or without a CpG-containing oligonucleotide. In other instances, the adjuvant is alum, with or without a CpG-containing oligonucleotide. In other instances, the adjuvant is poly(D,L-lactide-co-glycolide), with or without a CpG-containing oligonucleotide. In other instances, the adjuvant is MPL, with or without a CpG-containing oligonucleotide. In some cases, the adjuvant is Matrix-M™, with or without a CpG-containing oligonucleotide. In some cases, the adjuvant is alum. In some cases, the adjuvant is MF59. In some cases, the adjuvant is alum+MF59. In some cases, the adjuvant is AS01. AS01 contains QS-21 Stimulon® adjuvant, MPL, and liposomes. In some cases, the adjuvant is AS03. A dose of S03 contains: 10.69 mg squalene; 11.86 mg DL-a-tocopherol; and 4.86 mg polysorbate-80. In some cases, the adjuvant is AS04. In some cases, the adjuvant is AS15. AS15 is a combination of QS-21 Stimulon® adjuvant, monophosphoryl lipid A, and CpG7909 (an oligonucleotide of the sequence 5'-TCGTCGTTTTGTCGTTTTGTCGTT-3; SEQ ID NO:123), in a liposomal formulation. In some cases, an immunogenic composition of the present disclosure comprises: a) an HCV E1/E2 heterodimer comprising: i) an HCV E1 polypeptide; and ii) a modified HCV E2 polypeptide comprising a Gly-Pro dipeptide appended to the N-terminus of an HCV E2 polypeptide (i.e., where the modified HCV E2 polypeptide is a Gly-Pro-E2 polypeptide); b) a polypeptide comprising an amino acid sequence having at least 95%, at least about 98%, at least about 99%, or 100%, amino acid sequence identity to the following amino acid sequence: MSTNPKPQRKTKRNTNRRPQDVKFPGGGQI-VGGVYLLPRRGPRLGVRATRKTSERSQP RGRRQPIPKARRPEGRTWAQPGYPWPLYGNEGCG-WAGWLLSPRGSRPSWGPTDPRRRS RNLGKVIDTLTCGFADLMGYIPLVGAPLGGAARAL-AHGVRVLEDGVNYATGNLPG (SEQ ID NO:89); and having a length of 171 amino acids; and c) a pharmaceutically acceptable carrier. In some cases, the immunogenic composition comprises an adjuvant. In some instances, the adjuvant comprises MF59, alum, AS01, AS03, AS04, AS15, MPL, QS-21, or a CpG-containing oligonucleotide (e.g., CpG7909), or a combination of two of the foregoing. In some instances, the adjuvant comprises MF59. In some instances, the adjuvant comprises alum. In some instances, the adjuvant comprises alum+MPL. In some instances, the adjuvant comprises QS-21. In some cases, the immunogenic composition comprises a mixture of HCV E1/E2 heterodimers from different HCV genotypes. In some cases, the immunogenic composition comprises a mixture of HCV E1/E2 of genotype 1 and HCV E1/E2 of genotype 3. In some cases, the immunogenic composition comprises a mixture of HCV E1/E2 of genotype 1, HCV E1/E2 of genotype 2, and HCV E1/E2 of genotype 3.

12) In some cases, an immunogenic composition of the present disclosure comprises: a) an HCV E1/E2 heterodimer comprising: i) an HCV E1 polypeptide; and ii) a modified HCV E2 polypeptide comprising a Gly-Ser dipeptide appended to the N-terminus of an HCV E2 polypeptide (i.e., where the modified HCV E2 polypeptide is a Gly-Ser-E2 polypeptide); b) a polypeptide that comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRNTNRRPQDVKFPGGGQI-VGGVYLLPRRGPRLGVRATRKTSERSQP RGRRQPIPKARRPEGRTWAQPGYPWPLYGNEGCG-WAGWLLSPRGSRPSWGPTDPRRRS RNLGKVIDTLTCGFADLMGYIPLVGAPLGGAARAL-AHGVRVLEDGVNYATGNLPG (SEQ ID NO:89); and can has a length of from 171 amino acids (aa) to 180 aa (e.g., 171 aa, 172 aa, 173 aa, 174 aa, 175 aa, 176 aa, 177 aa, 178 aa, 179 aa, or 180 aa); and c) a pharmaceutically acceptable carrier. In some cases, the immunogenic composition comprises an adjuvant. In some instances, the adjuvant is MF59, with or without a CpG-containing oligonucleotide. In other instances, the adjuvant is alum, with or without a CpG-containing oligonucleotide. In other instances, the adjuvant is poly(D,L-lactide-co-glycolide), with or without a CpG-containing oligonucleotide. In other instances, the adjuvant is MPL, with or without a CpG-containing oligonucleotide. In some cases, the adjuvant is Matrix-M™, with or without a CpG-containing oligonucleotide. In some cases, the adjuvant is alum. In some cases, the adjuvant is MF59. In some cases, the adjuvant is alum+MF59. In some cases, the adjuvant is AS01. AS01 contains QS-21 Stimulon® adjuvant, MPL, and liposomes. In some cases, the adjuvant is AS03. A dose of S03 contains: 10.69 mg squalene; 11.86 mg DL-a-tocopherol; and 4.86 mg polysorbate-80. In some cases, the adjuvant is AS04. In some cases, the adjuvant is AS15. AS15 is a combination of QS-21 Stimulon® adjuvant, monophosphoryl lipid A, and CpG7909 (an oligonucleotide of the sequence 5'-TCGTCGTTTTGTCGTTTTGTCGTT-3; SEQ ID NO:123), in a liposomal formulation. In some cases, an immunogenic composition of the present disclosure comprises: a) an HCV E1/E2 heterodimer comprising: i) an HCV E1 polypeptide; and ii) a modified HCV E2 polypeptide comprising a Gly-Ser dipeptide appended to the N-terminus of an HCV E2 polypeptide (i.e., where the modified HCV E2 polypeptide is a Gly-Ser-E2 polypeptide); b) a polypeptide comprising an amino acid sequence having at least 95%, at least about 98%, at least about 99%, or 100%, amino acid sequence identity to the following amino acid sequence: MSTNPKPQRKTKRNTNRRPQDVKFPGGGQI-VGGVYLLPRRGPRLGVRATRKTSERSQP RGRRQPIPKARRPEGRTWAQPGYPWPLYGNEGCG-WAGWLLSPRGSRPSWGPTDPRRRS RNLGKVIDTLTCGFADLMGYIPLVGAPLGGAARAL-AHGVRVLEDGVNYATGNLPG (SEQ ID NO:89); and having a length of 171 amino acids; and c) a pharmaceutically acceptable carrier. In some cases, the immunogenic composition comprises an adjuvant. In some instances, the adjuvant comprises MF59, alum, AS01, AS03, AS04, AS15, MPL, QS-21, or a CpG-containing oligonucleotide (e.g., CpG7909), or a combination of two of the foregoing. In some instances, the adjuvant comprises MF59. In some instances, the adjuvant comprises alum. In some instances, the adjuvant comprises alum+MPL. In some instances, the adjuvant comprises QS-21. In some cases, the immunogenic composition comprises a mixture of HCV E1/E2 heterodimers from different HCV genotypes. In some cases, the immunogenic composition comprises a mixture of HCV E1/E2 of genotype 1 and HCV E1/E2 of genotype 3. In some cases, the immunogenic composition comprises a mixture of HCV E1/E2 of genotype 1, HCV E1/E2 of genotype 2, and HCV E1/E2 of genotype 3.

13) In some cases, an immunogenic composition of the present disclosure comprises: a) an HCV E1/E2 heterodimer comprising: i) an HCV E1 polypeptide; and ii) a modified HCV E2 polypeptide comprising a Gly-Pro dipeptide appended to the N-terminus of an HCV E2 polypeptide (i.e., where the modified HCV E2 polypeptide is a Gly-Pro-E2 polypeptide); b) a polypeptide that comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGSGK-STKVPAAYAAQGYKVLVLNPSVAATLGF-GAYMSKAHGIDPNIRTGVRTIT TGSPITYSTYGK-FLADGGCSGGAYDIIICDECHSTDATSILGIGTVLDQ AETAGARLVVLA TATPPGSVTVPHPNIEEVALSTT-GEIPFYGKAIPLEVIKGGRHLIFCHSKKKCDE-LAAKLV ALGINAVAYYRGLDVSVIPTSGDVVV-VATDALMTGFTGDFDSVIDCN (SEQ ID NO:81); and that has a length of from 228 amino acids (aa) to 235 aa (e.g., 228 aa, 229 aa, 230 aa, 231 aa, 232 aa, 233 aa, 234 aa, or 235 aa); and c) a pharmaceutically acceptable carrier. In some cases, the immunogenic composition comprises an adjuvant. In some instances, the adjuvant is MF59, with or without a CpG-containing oligonucleotide. In other instances, the adjuvant is alum, with or without a CpG-containing oligonucleotide. In other instances, the adjuvant is poly(D,L-lactide-co-glycolide), with or without a CpG-containing oligonucleotide. In other instances, the adjuvant is MPL, with or without a CpG-containing oligonucleotide. In some cases, the adjuvant is Matrix-M™, with or without a CpG-containing oligonucleotide. In some cases, the adjuvant is alum. In some cases, the adjuvant is MF59. In some cases, the adjuvant is alum+MF59. In some cases, the adjuvant is AS01. AS01 contains QS-21 Stimulon® adjuvant, MPL, and liposomes. In some cases, the adjuvant is AS03. A dose of S03 contains: 10.69 mg squalene; 11.86 mg DL-a-tocopherol; and 4.86 mg polysorbate-80. In some cases, the adjuvant is AS04. In some cases, the adjuvant is AS15. AS15 is a combination of QS-21 Stimulon® adjuvant, monophosphoryl lipid A, and CpG7909 (an oligonucleotide of the sequence 5'-TCGTCGTTTTGTCGTTTTGTCGTT-3; SEQ ID NO:123), in a liposomal formulation. In some cases, an immunogenic composition of the present disclosure comprises: a) an HCV E1/E2 heterodimer comprising: i) an HCV E1 polypeptide; and ii) a modified HCV E2 polypeptide comprising a Gly-Pro dipeptide appended to the N-terminus of an HCV E2 polypeptide (i.e., where the modified HCV E2 polypeptide is a Gly-Pro-E2 polypeptide); b) a polypeptide comprising an amino acid sequence having at least 95%, at least about 98%, at least about 99%, or 100%, amino acid sequence identity to the following amino acid sequence:

(SEQ ID NO: 81)
LHAPTGSGKSTKVPAAYAAQGYKVLVLNPSVAATLGFGAYMSKAHGIDPN

IRTGVRTITTGSPITYSTYGKFLADGGCSGGAYDIIICDECHSTDATSIL

GIGTVLDQAETAGARLVVLATATPPGSVTVPHPNIEEVALSTTGEIPFYG

KAIPLEVIKGGRHLIFCHSKKKCDELAAKLVALGINAVAYYRGLDVSVIP

TSGDVVVVATDALMTGFTGDFDSVIDCN;

and having a length of 228 amino acids; and c) a pharmaceutically acceptable carrier. In some cases, the immunogenic composition comprises an adjuvant. In some instances, the adjuvant comprises MF59, alum, AS01, AS03, AS04, AS15, MPL, QS-21, or a CpG-containing oligonucleotide (e.g., CpG7909), or a combination of two of the foregoing. In some instances, the adjuvant comprises MF59. In some instances, the adjuvant comprises alum. In some instances, the adjuvant comprises alum+MPL. In some instances, the adjuvant comprises QS-21. In some cases, the immunogenic composition comprises a mixture of HCV E1/E2 heterodimers from different HCV genotypes. In some cases, the immunogenic composition comprises a mixture of HCV E1/E2 of genotype 1 and HCV E1/E2 of genotype 3. In some cases, the immunogenic composition comprises a mixture of HCV E1/E2 of genotype 1, HCV E1/E2 of genotype 2, and HCV E1/E2 of genotype 3.

14) In some cases, an immunogenic composition of the present disclosure comprises: a) an HCV E1/E2 heterodimer comprising: i) an HCV E1 polypeptide; and ii) a modified HCV E2 polypeptide comprising a Gly-Ser dipeptide appended to the N-terminus of an HCV E2 polypeptide (i.e., where the modified HCV E2 polypeptide is a Gly-Ser-E2 polypeptide); b) a polypeptide that comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence:

(SEQ ID NO: 81)
LHAPTGSGKSTKVPAAYAAQGYKVLVLNPSVAATLGFGAYMSKAHGIDPN

IRTGVRTITTGSPITYSTYGKFLADGGCSGGAYDIIICDECHSTDATSIL

GIGTVLDQAETAGARLVVLATATPPGSVTVPHPNIEEVALSTTGEIPFYG

KAIPLEVIKGGRHLIFCHSKKKCDELAAKLVALGINAVAYYRGLDVSVIP

TSGDVVVVATDALMTGFTGDFDSVIDCN;

and that has a length of from 228 amino acids (aa) to 235 aa (e.g., 228 aa, 229 aa, 230 aa, 231 aa, 232 aa, 233 aa, 234 aa, or 235 aa); and c) a pharmaceutically acceptable carrier. In some cases, the immunogenic composition comprises an adjuvant. In some instances, the adjuvant is MF59, with or without a CpG-containing oligonucleotide. In other instances, the adjuvant is alum, with or without a CpG-containing oligonucleotide. In other instances, the adjuvant is poly(D,L-lactide-co-glycolide), with or without a CpG-containing oligonucleotide. In other instances, the adjuvant is MPL, with or without a CpG-containing oligonucleotide. In some cases, the adjuvant is Matrix-M™, with or without a CpG-containing oligonucleotide. In some cases, the adjuvant is alum. In some cases, the adjuvant is MF59. In some cases, the adjuvant is alum+MF59. In some cases, the adjuvant is AS01. AS01 contains QS-21 Stimulon® adjuvant, MPL, and liposomes. In some cases, the adjuvant is AS03. A dose of S03 contains: 10.69 mg squalene; 11.86 mg DL-a-tocopherol; and 4.86 mg polysorbate-80. In some cases, the adjuvant is AS04. In some cases, the adjuvant is AS15. AS15 is a combination of QS-21 Stimulon® adjuvant, monophosphoryl lipid A, and CpG7909 (an oligonucleotide of the sequence 5'-TCGTCGTTTTGTCGTTTTGTCGTT-3; SEQ ID NO:123), in a liposomal formulation. In some cases, an immunogenic composition of the present disclosure comprises: a) an HCV E1/E2 heterodimer comprising: i) an HCV E1 polypeptide; and ii) a modified HCV E2 polypeptide comprising a Gly-Ser dipeptide appended to the N-terminus of an HCV E2 polypeptide (i.e., where the modified HCV E2 polypeptide is a Gly-Ser-E2 polypeptide); b) a polypeptide comprising an amino acid sequence having at least 95%, at least about 98%, at least about 99%, or 100%, amino acid sequence identity to the following amino acid sequence:

(SEQ ID NO: 81)
LHAPTGSGKSTKVPAAYAAQGYKVLVLNPSVAATLGFGAYMSKAHGIDPN

IRTGVRTITTGSPITYSTYGKFLADGGCSGGAYDIIICDECHSTDATSIL

GIGTVLDQAETAGARLVVLATATPPGSVTVPHPNIEEVALSTTGEIPFYG

KAIPLEVIKGGRHLIFCHSKKKCDELAAKLVALGINAVAYYRGLDVSVIP

TSGDVVVVATDALMTGFTGDFDSVIDCN;

and having a length of 228 amino acids; and c) a pharmaceutically acceptable carrier. In some cases, the immunogenic composition comprises an adjuvant. In some instances, the adjuvant comprises MF59, alum, AS01, AS03, AS04, AS15, MPL, QS-21, or a CpG-containing oligonucleotide (e.g., CpG7909), or a combination of two of the foregoing. In some instances, the adjuvant comprises MF59. In some instances, the adjuvant comprises alum. In some instances, the adjuvant comprises alum+MPL. In some instances, the adjuvant comprises QS-21. In some cases, the immunogenic composition comprises a mixture of HCV E1/E2 heterodimers from different HCV genotypes. In some cases, the immunogenic composition comprises a mixture of HCV E1/E2 of genotype 1 and HCV E1/E2 of genotype 3. In some cases, the immunogenic composition comprises a mixture of HCV E1/E2 of genotype 1, HCV E1/E2 of genotype 2, and HCV E1/E2 of genotype 3.

15) In some cases, an immunogenic composition of the present disclosure comprises: a) an HCV E1/E2 heterodimer comprising: i) an HCV E1 polypeptide; and ii) a modified HCV E2 polypeptide comprising a Gly-Pro dipeptide appended to the N-terminus of an HCV E2 polypeptide (i.e., where the modified HCV E2 polypeptide is a Gly-Pro-E2 polypeptide); b) a polypeptide that comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence:
QASLLKVPYFVRVQGLLRICALARKMAGGHYVQ-
MAIIKLGALTGTYVYNALTPLRDW AHNGLRDLAVA-
VEPVVFSQMETKLITWGADTAACGDIINGLPVSARR-
GREILLGPADG
MVSKGWRLLAPITAYAQQTRGLLGCIITSLT-
GRDKNQVEGEVQIVSTAAQTFLATCING
VCWTVYHGAGTRTIAS-
PKGPVIQMYTNVDQDLVGW-
PAPQGARSLTPCTCGSSDLYLVT RHAD-
VIPVRRRGDSRGSLLSPRPISYLKGS
AGGPLLCPAGHAVGIFRAAVCTRGVAKAV DFIPVEN-
LETTMRSPVFTDNSSPPAVPQSFQVAHLHAPTGSGK-
STKVPAAYAAQGYKVL VLNPSVAATLGF-
GAYMSKAHGIDPNIRTGVRTITTGSPITYSTYGKFLA
DGGCSGGAYDII ICDECHSTDATSIL-
GIGTVLDQAETAGARLVVLATATPPGSVTVPHPNIE-
EVALSTTGEIPF YGKAIPLEVIKGGRHLIFCHS-
KKKCDELAAKLVALGINAVAYYRGLDVSVIPTSGDV
VV VATDALMTGFTGDFDSVIDCN (SEQ ID NO:100);
and that has a length of from 553 amino acids (aa) to 560 aa (e.g., aa, 554 aa, 555 aa, 556 aa, 557 aa, 558 aa, 559 aa, or 560 aa); and c) a pharmaceutically acceptable carrier. In some cases, the immunogenic composition comprises an adjuvant. In some instances, the adjuvant is MF59, with or without a CpG-containing oligonucleotide. In other instances, the adjuvant is alum, with or without a CpG-containing oligonucleotide. In other instances, the adjuvant is poly(D,L-lactide-co-glycolide), with or without a CpG-containing oligonucleotide. In other instances, the adjuvant is MPL, with or without a CpG-containing oligonucleotide. In some cases, the adjuvant is Matrix-M™, with or without a CpG-containing oligonucleotide. In some cases, the adjuvant is alum. In some cases, the adjuvant is MF59. In some cases, the adjuvant is alum+MF59. In some cases, the adjuvant is AS01. AS01 contains QS-21 Stimulon® adjuvant, MPL, and liposomes. In some cases, the adjuvant is AS03. A dose of S03 contains: 10.69 mg squalene; 11.86 mg DL-a-tocopherol; and 4.86 mg polysorbate-80. In some cases, the adjuvant is AS04. In some cases, the adjuvant is AS15. AS15 is a combination of QS-21 Stimulon® adjuvant, monophosphoryl lipid A, and CpG7909 (an oligonucleotide of the sequence 5'-TCGTCGTTTTGTCGTTTTGTCGTT-3'; SEQ ID NO:123), in a liposomal formulation. In some cases, an immunogenic composition of the present disclosure comprises: a) an HCV E1/E2 heterodimer comprising: i) an HCV E1 polypeptide; and ii) a modified HCV E2 polypeptide comprising a Gly-Pro dipeptide appended to the N-terminus of an HCV E2 polypeptide (i.e., where the modified HCV E2 polypeptide is a Gly-Pro-E2 polypeptide); b) a polypeptide comprising an amino acid sequence having at least 95%, at least about 98%, at least about 99%, or 100%, amino acid sequence identity to the following amino acid sequence:
QASLLKVPYFVRVQGLLRICALARKMAGGHYVQ-
MAIIKLGALTGTYVYNALTPLRDW AHNGLRDLAVA-
VEPVVFSQMETKLITWGADTAACGDIINGLPVSARR-
GREILLGPADG
MVSKGWRLLAPITAYAQQTRGLLGCIITSLT-
GRDKNQVEGEVQIVSTAAQTFLATCING
VCWTVYHGAGTRTIAS-
PKGPVIQMYTNVDQDLVGW-
PAPQGARSLTPCTCGSSDLYLVT RHAD-
VIPVRRRGDSRGSLLSPRPISYLKGS
AGGPLLCPAGHAVGIFRAAVCTRGVAKAV DFIPVEN-
LETTMRSPVFTDNSSPPAVPQSFQVAHLHAPTGSGK-
STKVPAAYAAQGYKVL VLNPSVAATLGF-
GAYMSKAHGIDPNIRTGVRTITTGSPITYSTYGKFLA
DGGCSGGAYDII ICDECHSTDATSIL-
GIGTVLDQAETAGARLVVLATATPPGSVTVPHPNIE-
EVALSTTGEIPF YGKAIPLEVIKGGRHLIFCHS-
KKKCDELAAKLVALGINAVAYYRGLDVSVIPTSGDV
VV VATDALMTGFTGDFDSVIDCN (SEQ ID NO:100);
and having a length of 553 amino acids; and c) a pharmaceutically acceptable carrier. In some cases, the immunogenic composition comprises an adjuvant. In some instances, the adjuvant comprises MF59, alum, AS01, AS03, AS04, AS15, MPL, QS-21, or a CpG-containing oligonucleotide (e.g., CpG7909), or a combination of two of the foregoing. In some instances, the adjuvant comprises MF59. In some instances, the adjuvant comprises alum. In some instances, the adjuvant comprises alum+MPL. In some instances, the adjuvant comprises QS-21. In some cases, the immunogenic composition comprises a mixture of HCV E1/E2 heterodimers from different HCV genotypes. In some cases, the immunogenic composition comprises a mixture of HCV E1/E2 of genotype 1 and HCV E1/E2 of genotype 3. In some cases, the immunogenic composition comprises a mixture of HCV E1/E2 of genotype 1, HCV E1/E2 of genotype 2, and HCV E1/E2 of genotype 3.

16) In some cases, an immunogenic composition of the present disclosure comprises: a) an HCV E1/E2 heterodimer comprising: i) an HCV E1 polypeptide; and ii) a modified HCV E2 polypeptide comprising a Gly-Ser dipeptide appended to the N-terminus of an HCV E2 polypeptide (i.e., where the modified HCV E2 polypeptide is a Gly-Ser-E2 polypeptide); b) a polypeptide that comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence:
QASLLKVPYFVRVQGLLRICALARKMAGGHYVQ-
MAIIKLGALTGTYVYNALTPLRDW AHNGLRDLAVA-
VEPVVFSQMETKLITWGADTAACGDIINGLPVSARR-
GREILLGPADG
MVSKGWRLLAPITAYAQQTRGLLGCIITSLT-
GRDKNQVEGEVQIVSTAAQTFLATCING
VCWTVYHGAGTRTIAS-
PKGPVIQMYTNVDQDLVGW- PAPQGARSLTPCTCGSSDLYLVT RHADVIPVRRRGDSRGSLLSPRPISYLKGS AGGPLLCPAGHAVGIFRAAVCTRGVAKAV DFIPVENLETTMRSPVFTDNSSPPAVPQSFQVAHLHAPTGSGKSTKVPAAYAAQGYKVL VLNPSVAATLGFGAYMSKAHGIDPNIRTGVRTITTGSPITYSTYGKFLA DGGCSGGAYDII ICDECHSTDATSILGIGTVLDQAETAGARLVVLATATPPGSVTVPHPNIEEVALSTTGEIPF YGKAIPLEVIKGGRHLIFCHSKKKCDELAAKLVALGINAVAYYRGLDVSVIPTSGD VVV VATDALMTGFTGDFDSVIDCN (SEQ ID NO:100); and that has a length of from 553 amino acids (aa) to 560 aa (e.g., aa, 554 aa, 555 aa, 556 aa, 557 aa, 558 aa, 559 aa, or 560 aa); and c) a pharmaceutically acceptable carrier. In some cases, the immunogenic composition comprises an adjuvant. In some instances, the adjuvant is MF59, with or without a CpG-containing oligonucleotide. In other instances, the adjuvant is alum, with or without a CpG-containing oligonucleotide. In other instances, the adjuvant is poly(D,L-lactide-co-glycolide), with or without a CpG-containing oligonucleotide. In other instances, the adjuvant is MPL, with or without a CpG-containing oligonucleotide. In some cases, the adjuvant is Matrix-M™, with or without a CpG-containing oligonucleotide. In some cases, the adjuvant is alum. In some cases, the adjuvant is MF59. In some cases, the adjuvant is alum+MF59. In some cases, the adjuvant is AS01. AS01 contains QS-21 Stimulon® adjuvant, MPL, and liposomes. In some cases, the adjuvant is AS03. A dose of S03 contains: 10.69 mg squalene; 11.86 mg DL-a-tocopherol; and 4.86 mg polysorbate-80. In some cases, the adjuvant is AS04. In some cases, the adjuvant is AS15. AS15 is a combination of QS-21 Stimulon® adjuvant, monophosphoryl lipid A, and CpG7909 (an oligonucleotide of the sequence 5'-TCGTCGTTTTGTCGTTTTGTCGTT-3'; SEQ ID NO:123), in a liposomal formulation. In some cases, an immunogenic composition of the present disclosure comprises: a) an HCV E1/E2 heterodimer comprising: i) an HCV E1 polypeptide; and ii) a modified HCV E2 polypeptide comprising a Gly-Ser dipeptide appended to the N-terminus of an HCV E2 polypeptide (i.e., where the modified HCV E2 polypeptide is a Gly-Ser-E2 polypeptide); b) a polypeptide comprising an amino acid sequence having at least 95%, at least about 98%, at least about 99%, or 100%, amino acid sequence identity to the following amino acid sequence: QASLLKVPYFVRVQGLLRICALARKMAGGHYVQMAIIKLGALTGTYVYNALTPLRDW AHNGLRDLAVAVEPVVFSQMETKLITWGADTAACGDIINGLPVSARRGREILLGPADG MVSKGWRLLAPITAYAQQTRGLLGCIITSLTGRDKNQVEGEVQIVSTAAQTFLATCING VCWTVYHGAGTRTIASPKGPVIQMYTNVDQDLVGWPAPQGARSLTPCTCGSSDLYLVT RHADVIPVRRRGDSRGSLLSPRPISYLKGS AGGPLLCPAGHAVGIFRAAVCTRGVAKAV DFIPVENLETTMRSPVFTDNSSPPAVPQSFQVAHLHAPTGSGKSTKVPAAYAAQGYKVL VLNPSVAATLGFGAYMSKAHGIDPNIRTGVRTITTGSPITYSTYGKFLA DGGCSGGAYDII ICDECHSTDATSILGIGTVLDQAETAGARLVVLATATPPGSVTVPHPNIEEVALSTTGEIPF YGKAIPLEVIKGGRHLIFCHSKKKCDELAAKLVALGINAVAYYRGLDVSVIPTSGDVVV VATDALMTGFTGDFDSVIDCN (SEQ ID NO:100); and having a length of 553 amino acids; and c) a pharmaceutically acceptable carrier. In some cases, the immunogenic composition comprises an adjuvant. In some instances, the adjuvant comprises MF59, alum, AS01, AS03, AS04, AS15, MPL, QS-21, or a CpG-containing oligonucleotide (e.g., CpG7909), or a combination of two of the foregoing. In some instances, the adjuvant comprises MF59. In some instances, the adjuvant comprises alum. In some instances, the adjuvant comprises alum+MPL. In some instances, the adjuvant comprises QS-21. In some cases, the immunogenic composition comprises a mixture of HCV E1/E2 heterodimers from different HCV genotypes. In some cases, the immunogenic composition comprises a mixture of HCV E1/E2 of genotype 1 and HCV E1/E2 of genotype 3. In some cases, the immunogenic composition comprises a mixture of HCV E1/E2 of genotype 1, HCV E1/E2 of genotype 2, and HCV E1/E2 of genotype 3.

17) In some cases, an immunogenic composition of the present disclosure comprises: a) an HCV E1/E2 heterodimer comprising: i) an HCV E1 polypeptide; and ii) a modified HCV E2 polypeptide comprising a Gly-Pro dipeptide appended to the N-terminus of an HCV E2 polypeptide (i.e., where the modified HCV E2 polypeptide is a Gly-Pro-E2 polypeptide); b) a polypeptide that comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGSGKSTKVPAAYAAQGYKVLVLNPSVAATLGFGAYMSKAHGIDPNIRTGVRTIT TGSPITYSTYGKFLADGGCSGGAYDIIICDECHSTDATSILGIGTVLDQ AETAGARLVVLA TATPPGSVTVPHPNIEEVALSTTGEIPFYGKAIPLEVIKGGRHLIFCHSKKKCDELAAKLV ALGINAVAYYRGLDVSVIPTSGDVVVVATDALMTGFTGDFDSVIDCNTCVTQTVDFSLD PTFTIETTTLPQDAVSRTQRRGRTGRGKPGIYRFVAPGERPSGMFDSSVLCECYDAGCA WYELTPAETTVRLRAYMNTPGLPVCQDHLEFWEGVFTGLTHIDAHFLSQTKQSGENLP YLVAYQATVCARAQAPPPSWDQMWKCLIRLKPTLHGPTPLLYRLGAVQNEVTLTHPIT KYIMTCMSADLEVVTSTWVLVGGVLAALAAYCLSTGCVVIVGRIVLSGKPAIIPDREVL YREFDEMEECSQHLPYIEQGMMLAEQFKQKALGLLQTASRQAEVIAPAVQTNWQKLEA FWAKHMWNFISGIQYLAGLSTLPGNPAIASLMAFTAAVTSPLTTSQTLLFNILGGWVAA QLAAPGAATAFVGAGLAGAAIGSVGLGKVLVDILAGYGAGVAGALVAFKIMSGEVPST EDLVNLLPAILSPGALVVGVVCAAILRRHVGPGEGAVQWMNRLIAFASRGNHVSPTHY VPESDAAARVTAILSSLTVTQLLRRLHQWISSECTTPCSGSWLRDI WDWICEVLSDFKTW LKAKLMPQLPG (SEQ ID NO:101); and that has a length of from 778 amino acids (aa) to 790 aa (e.g., 778 aa, 779 aa, 780 aa, 781 aa, 782 aa, 783 aa, 784 aa, 785 aa, 786 aa, 787 aa, 788 aa, or 790 aa); and c) a pharmaceutically acceptable carrier. In some cases, the immunogenic composition comprises an adjuvant. In some instances, the adjuvant is MF59, with or without a CpG-containing oligonucleotide. In other instances, the adjuvant is alum, with or without a CpG-containing oligonucleotide. In other instances, the adjuvant is poly(D,L-lactide-co-glycolide), with or without a CpG-containing oligonucleotide. In other instances, the adjuvant is MPL, with or without a CpG-containing oligonucleotide. In some cases, the adjuvant is Matrix-M™, with or without a CpG-containing oligonucleotide. In some cases, the adjuvant is alum. In some cases, the adjuvant is MF59. In some cases, the adjuvant is alum+MF59. In some cases, the adjuvant is AS01. AS01 contains QS-21 Stimulon® adjuvant, MPL, and liposomes. In some cases, the adjuvant is AS03. A dose of S03 contains: 10.69 mg squalene; 11.86 mg DL-a-tocopherol; and 4.86 mg polysorbate-80. In some cases, the adjuvant is AS04. In some cases, the adjuvant is AS15. AS15 is a combination of QS-21 Stimulon® adjuvant, monophosphoryl lipid A, and CpG7909 (an oligonucleotide of the sequence 5'-TCGTCGTTTTGTCGTTTTGTCGTT-3'; SEQ ID NO:123), in a liposomal formulation. In some cases, an immunogenic composition of the present disclosure comprises: a) an HCV E1/E2 heterodimer comprising: i) an HCV E1 polypeptide; and ii) a modified HCV E2 polypeptide comprising a Gly-Pro dipeptide appended to the N-terminus of an HCV E2 polypeptide (i.e., where the modified HCV E2 polypeptide is a Gly-Pro-E2 polypeptide); b) a polypeptide comprising an amino acid sequence having at least 95%, at least about 98%, at least about 99%, or 100%, amino acid sequence identity to the following amino acid sequence: LHAPTGSGK-STKVPAAYAAQGYKVLVLNPSVAATLGF-GAYMSKAHGIDPNIRTGVRTIT TGSPITYSTYGK-FLADGGCSGGAYDIIICDECHSTDATSILGIGTVLDQ AETAGARLVVLA TATPPGSVTVPHPNIEEVALSTT-GEIPFYGKAIPLEVIKGGRHLIFCHSKKKCDE-LAAKLV ALGINAVAYYRGLDVSVIPTSGDVVV-VATDALMTGFTGDFDSVIDCNTCVTQTVDFSLD PTFTIETTTLPQDAVSRTQRRGRT-GRGKPGIYRFVAPGERPSGMFDSSVLCECYDAGCA WYELTPAETTVRL-RAYMNTPGLPVCQDHLEFWEGVFTGLTHI-DAHFLSQTKQSGENLP YLVAYQATVCAR-AQAPPPSWDQMWKCLIRLKPTLHGPTPLLYRLGAVQ-NEVTLTHPIT KYIMTCMSADLEVVTSTWVLVGGVLAALAAYCL-STGCVVIVGRIVLSGKPAIIPDREVL YREFDE-MEECSQHLPYIEQGMMLAEQFKQKALGLLQTAS-RQAEVIAPAVQTNWQKLEA FWAKHMWNFISGIQYLAGLSTLPGNPAIASLMA-FTAAVTSPLTTSQTLLFNILGGWVAA QLAAP-GAATAFVGAGLAGAAIGSVGLGKVLVDI-LAGYGAGVAGALVAFKIMSGEVPST EDLVNLLPAILSPGALVVGVVCAAILR-RHVGPGEGAVQWMNRLIAFASRGNHVSPTHY VPES-DAAARV-TAILSSLTVTQLLRRLHQWISSECTTPCSGSWLRDI WDWICEVLSDFKTW LKAKLMPQLPG (SEQ ID NO:101); and having a length of 778 amino acids; and c) a pharmaceutically acceptable carrier. In some cases, the immunogenic composition comprises an adjuvant. In some instances, the adjuvant comprises MF59, alum, AS01, AS03, AS04, AS15, MPL, QS-21, or a CpG-containing oligonucleotide (e.g., CpG7909), or a combination of two of the foregoing. In some instances, the adjuvant comprises MF59. In some instances, the adjuvant comprises alum. In some instances, the adjuvant comprises alum+MPL. In some instances, the adjuvant comprises QS-21. In some cases, the immunogenic composition comprises a mixture of HCV E1/E2 heterodimers from different HCV genotypes. In some cases, the immunogenic composition comprises a mixture of HCV E1/E2 of genotype 1 and HCV E1/E2 of genotype 3. In some cases, the immunogenic composition comprises a mixture of HCV E1/E2 of genotype 1, HCV E1/E2 of genotype 2, and HCV E1/E2 of genotype 3.

18) In some cases, an immunogenic composition of the present disclosure comprises: a) an HCV E1/E2 heterodimer comprising: i) an HCV E1 polypeptide; and ii) a modified HCV E2 polypeptide comprising a Gly-Ser dipeptide appended to the N-terminus of an HCV E2 polypeptide (i.e., where the modified HCV E2 polypeptide is a Gly-Ser-E2 polypeptide); b) a polypeptide that comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGSGK-STKVPAAYAAQGYKVLVLNPSVAATLGF-GAYMSKAHGIDPNIRTGVRTIT TGSPITYSTYGK-FLADGGCSGGAYDIIICDECHSTDATSILGIGTVLDQ AETAGARLVVLA TATPPGSVTVPHPNIEEVALSTT-GEIPFYGKAIPLEVIKGGRHLIFCHSKKKCDE-LAAKLV ALGINAVAYYRGLDVSVIPTSGDVVV-VATDALMTGFTGDFDSVIDCNTCVTQTVDFSLD PTFTIETTTLPQDAVSRTQRRGRT-GRGKPGIYRFVAPGERPSGMFDSSVLCECYDAGCA WYELTPAETTVRL-RAYMNTPGLPVCQDHLEFWEGVFTGLTHI-DAHFLSQTKQSGENLP YLVAYQATVCAR-AQAPPPSWDQMWKCLIRLKPTLHGPTPLLYRLGAVQ-NEVTLTHPIT KYIMTCMSADLEVVTSTWVLVGGVLAALAAYCL-STGCVVIVGRIVLSGKPAIIPDREVL YREFDE-MEECSQHLPYIEQGMMLAEQFKQKALGLLQTAS-RQAEVIAPAVQTNWQKLEA FWAKHMWNFISGIQYLAGLSTLPGNPAIASLMA-FTAAVTSPLTTSQTLLFNILGGWVAA QLAAP-GAATAFVGAGLAGAAIGSVGLGKVLVDI-LAGYGAGVAGALVAFKIMSGEVPST EDLVNLLPAILSPGALVVGVVCAAILR-RHVGPGEGAVQWMNRLIAFASRGNHVSPTHY VPES-DAAARV-TAILSSLTVTQLLRRLHQWISSECTTPCSGSWLRDI WDWICEVLSDFKTW LKAKLMPQLPG (SEQ ID NO:101); and that has a length of from 778 amino acids (aa) to 790 aa (e.g., 778 aa, 779 aa, 780 aa, 781 aa, 782 aa, 783 aa, 784 aa, 785 aa, 786 aa, 787 aa, 788 aa, or 790 aa); and c) a pharmaceutically acceptable carrier. In some cases, the immunogenic composition comprises an adjuvant. In some instances, the adjuvant is MF59, with or without a CpG-containing oligonucleotide. In other instances, the adjuvant is alum, with or without a CpG-containing oligonucleotide. In other instances, the adjuvant is poly(D,L-lactide-co-glycolide), with or without a CpG-containing oligonucleotide. In other instances, the adjuvant is MPL, with or without a CpG-containing oligonucleotide. In some cases, the adjuvant is Matrix-M™, with or without a CpG-containing oligonucleotide. In some cases, the adjuvant is alum. In some cases, the adjuvant is MF59. In some cases, the adjuvant is alum+MF59. In some cases, the adjuvant is AS01. AS01 contains QS-21 Stimulon® adjuvant, MPL, and liposomes. In some cases, the adjuvant is AS03. A dose of S03 contains: 10.69 mg squalene; 11.86 mg DL-a-tocopherol; and 4.86 mg polysorbate-80. In some cases, the adjuvant is AS04. In some cases, the adjuvant is AS15. AS15 is a combination of QS-21 Stimulon® adjuvant, monophosphoryl lipid A, and CpG7909 (an oligonucleotide of the sequence 5'-TCGTCGTTTTGTCGTTTTGTCGTT-3'; SEQ ID NO:123), in a liposomal formulation. In some cases, an immunogenic composition of the present disclosure comprises: a) an HCV E1/E2 heterodimer comprising: i) an HCV E1 polypeptide; and ii) a modified HCV E2 polypeptide comprising a Gly-Ser dipeptide appended to the N-terminus of an HCV E2 polypeptide (i.e., where the modified HCV E2 polypeptide is a Gly-Ser-E2 polypeptide); b) a polypeptide comprising an amino acid sequence having at least 95%, at least about 98%, at least about 99%, or 100%, amino acid sequence identity to the following amino acid sequence: LHAPTGSGK- STKVPAAYAAQGYKVLVLNPSVAATLGF- GAYMSKAHGIDPNIRTGVRTIT TGSPITYSTYGK- FLADGGCSGGAYDIIICDECHSTDATSILGIGTVLDQA ETAGARLVVLA TATPPGSVTVPHPNIEEVALSTT- GEIPFYGKAIPLEVIKGGRHLIFCHSKKKCDE- LAAKLV ALGINAVAYYRGLDVSVIPTSGDVVV- VATDALMTGFTGDFDSVIDCNTCVTQTVDFSLD PTFTIETTTLPQDAVSRTQRRGRT- GRGKPGIYRFVAPGERPSGMFDSSVLCECYDAGCA WYELTPAETTVRL- RAYMNTPGLPVCQDHLEFWEGVFTGLTHI- DAHFLSQTKQSGENLP YLVAYQATVCAR- AQAPPPSWDQMWKCLIRLKPTLHGPTPLLYRLGAVQ- NEVTLTHPIT KYIMTCMSADLEVVTSTWVLVGGVLAALAAYCL- STGCVVIVGRIVLSGKPAIIPDREVL YREFDE- MEECSQHLPYIEQGMMLAEQFKQKALGLLQTAS- RQAEVIAPAVQTNWQKLEA FWAKHMWNFISGIQYLAGLSTLPGNPAIASLMA- FTAAVTSPLTTSQTLLFNILGGWVAA QLAAP- GAATAFVGAGLAGAAIGSVGLGKVLVDI- LAGYGAGVAGALVAFKIMSGEVPST EDLVNLLPAILSPGALVVGVVCAAILR- RHVGPGEGAVQWMNRLIAFASRGNHVSPTHY VPES- DAAARV- TAILSSLTVTQLLRRLHQWISSECTTPCSGSWLRDI WDWICEVLSDFKTW LKAKLMPQLPG (SEQ ID NO:101); and having a length of 778 amino acids; and c) a pharmaceutically acceptable carrier. In some cases, the immunogenic composition comprises an adjuvant. In some instances, the adjuvant comprises MF59, alum, AS01, AS03, AS04, AS15, MPL, QS-21, or a CpG-containing oligonucleotide (e.g., CpG7909), or a combination of two of the foregoing. In some instances, the adjuvant comprises MF59. In some instances, the adjuvant comprises alum. In some instances, the adjuvant comprises alum+MPL. In some instances, the adjuvant comprises QS-21. In some cases, the immunogenic composition comprises a mixture of HCV E1/E2 heterodimers from different HCV genotypes. In some cases, the immunogenic composition comprises a mixture of HCV E1/E2 of genotype 1 and HCV E1/E2 of genotype 3. In some cases, the immunogenic composition comprises a mixture of HCV E1/E2 of genotype 1, HCV E1/E2 of genotype 2, and HCV E1/E2 of genotype 3.

Compositions Comprising a Polypeptide Comprising T-Cell Epitopes Present in an HCV Polypeptide Other than E1 and E2

The present disclosure provides an immunogenic composition comprising: a) a polypeptide comprising one or more T-cell epitopes present in an HCV polypeptide other than E1 and E2; and b) a pharmaceutically acceptable excipient. For simplicity, a "polypeptide comprising one or more T-cell epitopes present in an HCV polypeptide other than E1 and E2" is referred to as an "HCV T-cell epitope polypeptide." In some cases, the immunogenic composition comprises an adjuvant. Thus, the present disclosure provides an immunogenic composition comprising: a) an HCV T-cell epitope polypeptide; b) a pharmaceutically acceptable excipient; and c) an adjuvant. An immunogenic composition of the present disclosure that comprises a polypeptide comprising one or more T-cell epitopes present in an HCV polypeptide other than E1 and E2 does not include an HCV E1/E2 heterodimer, an HCV E2 polypeptide, or an HCV E1 polypeptide.

In some cases, an HCV T-cell epitope polypeptide is a modified T-cell epitope polypeptide that comprises from 1 to 6 additional amino acids at the N-terminus of the modified HCV T-cell epitope polypeptide, where the from 1 to 6 additional amino acids are Gly-Pro, Ser, Gly, or Gly-Ser. In some cases, an HCV T-cell epitope polypeptide is a modified HCV T-cell epitope polypeptide that comprises from 1 to 6 additional amino acids at the C-terminus of the modified HCV T-cell epitope polypeptide, where the from 1 to 6 additional amino acids are LEVLFQ (SEQ ID NO:76), ENLYYFQ (SEQ ID NO:83), LVPR (SEQ ID NO:78), I(E/D)GR (SEQ ID NO:90), or DDDDK (SEQ ID NO:77).

In some cases, the HCV T-cell epitope polypeptide does not include a neotope; for example, in some cases, the HCV T-cell epitope polypeptide does not include a junction formed by amino acid sequences that do not naturally occur adjacent to one another in a naturally-occurring HCV polypeptide.

In some cases, the HCV T-cell epitope polypeptide is a fusion polypeptide comprising: i) the HCV T-cell epitope polypeptide; and ii) a fusion partner polypeptide, where the fusion partner polypeptide can comprise a T-cell epitope present in a polypeptide other than an HCV polypeptide. In some cases, the immunogenic composition comprises: a) a fusion polypeptide comprising: i) an HCV T-cell epitope polypeptide; and ii) a fusion partner polypeptide comprising a T-cell epitope present in a polypeptide other than an HCV polypeptide; and b) a pharmaceutically acceptable excipient. In some cases, the immunogenic composition comprises: a) a fusion polypeptide comprising: i) an HCV T-cell epitope polypeptide; and ii) a fusion partner polypeptide comprising a T-cell epitope present in a polypeptide other than an HCV polypeptide; b) a pharmaceutically acceptable excipient; and c) an adjuvant.

In some cases, the immunogenic composition comprises: a) an HCV T-cell epitope polypeptide; b) a pharmaceutically acceptable excipient; and c) a non-HCV polypeptide. In some cases, the immunogenic composition comprises: a) an HCV T-cell epitope polypeptide; b) a pharmaceutically acceptable excipient; c) a non-HCV polypeptide; and d) an adjuvant. In some cases, the non-HCV polypeptide comprises one or more T-cell epitopes.

As noted above, an immunogenic composition of the present disclosure an HCV T-cell epitope polypeptide comprising a T-cell epitope present in an HCV protein other than E1 and E2.

In some cases, the HCV T-cell epitope polypeptide comprises 1, 2, 3, 4, 5, 6, 7, 8, 9, or 10, or more than 10 (e.g., from 10 to 15, from 15 to 20, from 20 to 25, or from 25 to 30, or more than 30), T cell epitopes. T-cell epitopes include epitopes recognized by cytotoxic T cells (e.g., $CD8^+$ T cells), and epitopes recognized by helper T cells (e.g., $CD4^+$ T cells).

An immunogenic composition of the present disclosure that comprises an HCV T-cell epitope polypeptide can, when administered to an individual in need thereof, induce a $CD4^+$ T cell response and/or a $CD8^+$ T cell response.

The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the HCV T-cell epitope polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein. A suitable source of T-cell epitopes includes CRM. Other examples of strong T helper epitopes are diphtheria toxoid, tetanus toxoid, meningococcal outer membrane protein, or mutant diphtheria protein CRM197 (see, e.g.: http://www(dot)medscape(dot) com/viewarticle/431127).

In some cases, the HCV T-cell epitope polypeptide comprises a single T-cell epitope. In some cases, the HCV T-cell epitope polypeptide comprises a single HCV-NS3 T-cell epitope. In some cases, the HCV T-cell epitope polypeptide comprises 2 or more T-cell epitopes. In some cases, the HCV T-cell epitope polypeptide comprises 2 or more HCV-NS3 T-cell epitopes. In some cases, the HCV T-cell epitope polypeptide comprises 3 or more HCV-NS3 T-cell epitopes. In some cases, the HCV T-cell epitope polypeptide comprises 4 or more HCV-NS3 T-cell epitopes. In some cases, the HCV T-cell epitope polypeptide comprises a single HCV-NS3 $CD4^+$ T-cell epitope. In some cases, the HCV T-cell epitope polypeptide comprises 2 or more HCV-NS3 $CD4^+$ T-cell epitopes. In some cases, the HCV T-cell epitope polypeptide comprises one or more HCV $CD8^+$ T cell epitopes. In some cases, the HCV T-cell epitope polypeptide comprises a single HCV-NS3 $CD8^+$ T-cell epitope. In some cases, the HCV T-cell epitope polypeptide comprises 2 or more HCV-NS3 $CD8^+$ T-cell epitopes. In some cases, the HCV T-cell epitope polypeptide comprises at least one HCV $CD4^+$ T cell epitope and at least one HCV $CD8^+$ T cell epitope. In some cases, the HCV T-cell epitope polypeptide comprises at least one HCV-NS3 $CD4^+$ T cell epitope and at least one HCV-NS3 $CD8^+$ T cell epitope. In some cases, HCV T-cell epitope polypeptide comprises 2 or more HCV-NS3 $CD4^+$ T-cell epitopes and 2 or more HCV-NS3 $CD8^+$ T-cell epitopes. In some cases, the HCV T-cell epitope polypeptide comprises 2, 3, 4, or 5 HCV-NS3 $CD4^+$ T-cell epitopes and 2, 3, 4, or 5 HCV-NS3 $CD8^+$ T-cell epitopes.

In some cases, the HCV T-cell epitope polypeptide comprises a single T-cell epitope. In some cases, the HCV T-cell epitope polypeptide comprises a single HCV-NS2 T-cell epitope. In some cases, the HCV T-cell epitope polypeptide comprises 2 or more T-cell epitopes. In some cases, the HCV T-cell epitope polypeptide comprises 2 or more HCV-NS2 T-cell epitopes. In some cases, the HCV T-cell epitope polypeptide comprises 3 or more HCV-NS2 T-cell epitopes. In some cases, the HCV T-cell epitope polypeptide comprises 4 or more HCV-NS2 T-cell epitopes. In some cases, the HCV T-cell epitope polypeptide comprises a single HCV-NS2 $CD4^+$ T-cell epitope. In some cases, the HCV T-cell epitope polypeptide comprises 2 or more HCV-NS2 $CD4^+$ T-cell epitopes. In some cases, the HCV T-cell epitope polypeptide comprises one or more HCV $CD8^+$ T cell epitopes. In some cases, the HCV T-cell epitope polypeptide comprises a single HCV-NS2 $CD8^+$ T-cell epitope. In some cases, the HCV T-cell epitope polypeptide comprises 2 or more HCV-NS2 $CD8^+$ T-cell epitopes. In some cases, the HCV T-cell epitope polypeptide comprises at least one HCV $CD4^+$ T cell epitope and at least one HCV $CD8^+$ T cell epitope. In some cases, the HCV T-cell epitope polypeptide comprises at least one HCV-NS2 $CD4^+$ T cell epitope and at least one HCV-NS2 $CD8^+$ T cell epitope. In some cases, HCV T-cell epitope polypeptide comprises 2 or more HCV-NS2 $CD4^+$ T-cell epitopes and 2 or more HCV-NS2 $CD8^+$ T-cell epitopes. In some cases, the HCV T-cell epitope polypeptide comprises 2, 3, 4, or 5 HCV-NS2 $CD4^+$ T-cell epitopes and 2, 3, 4, or 5 HCV-NS2 $CD8^+$ T-cell epitopes.

In some cases, the HCV T-cell epitope polypeptide comprises a single T-cell epitope. In some cases, the HCV T-cell epitope polypeptide comprises a single HCV-NS4A T-cell epitope. In some cases, the HCV T-cell epitope polypeptide comprises 2 or more T-cell epitopes. In some cases, the HCV T-cell epitope polypeptide comprises 2 or more HCV-NS4A T-cell epitopes. In some cases, the HCV T-cell epitope polypeptide comprises 3 or more HCV-NS4A T-cell epitopes. In some cases, the HCV T-cell epitope polypeptide comprises 4 or more HCV-NS4A T-cell epitopes. In some cases, the HCV T-cell epitope polypeptide comprises a single HCV-NS4A $CD4^+$ T-cell epitope. In some cases, the HCV T-cell epitope polypeptide comprises 2 or more HCV-NS4A $CD4^+$ T-cell epitopes. In some cases, the HCV T-cell epitope polypeptide comprises one or more HCV $CD8^+$ T cell epitopes. In some cases, the HCV T-cell epitope polypeptide comprises a single HCV-NS4A $CD8^+$ T-cell epitope. In some cases, the HCV T-cell epitope polypeptide comprises 2 or more HCV-NS4A $CD8^+$ T-cell epitopes. In some cases, the HCV T-cell epitope polypeptide comprises at least one HCV $CD4^+$ T cell epitope and at least one HCV $CD8^+$ T cell epitope. In some cases, the HCV T-cell epitope polypeptide comprises at least one HCV-NS4A $CD4^+$ T cell epitope and at least one HCV-NS4A $CD8^+$ T cell epitope. In some cases, HCV T-cell epitope polypeptide comprises 2 or more HCV-NS4A $CD4^+$ T-cell epitopes and 2 or more HCV-NS4A $CD8^+$ T-cell epitopes. In some cases, the HCV T-cell epitope polypeptide comprises 2, 3, 4, or 5 HCV-NS4A $CD4^+$ T-cell epitopes and 2, 3, 4, or 5 HCV-NS4A $CD8^+$ T-cell epitopes.

In some cases, the HCV T-cell epitope polypeptide comprises a single T-cell epitope. In some cases, the HCV T-cell epitope polypeptide comprises a single HCV-NS5A T-cell epitope. In some cases, the HCV T-cell epitope polypeptide comprises 2 or more T-cell epitopes. In some cases, the HCV T-cell epitope polypeptide comprises 2 or more HCV-NS5A T-cell epitopes. In some cases, the HCV T-cell epitope polypeptide comprises 3 or more HCV-NS5A T-cell epitopes. In some cases, the HCV T-cell epitope polypeptide comprises 4 or more HCV-NS5A T-cell epitopes. In some cases, the HCV T-cell epitope polypeptide comprises a single HCV-NS5A $CD4^+$ T-cell epitope. In some cases, the HCV T-cell epitope polypeptide comprises 2 or more HCV-NS5A $CD4^+$ T-cell epitopes. In some cases, the HCV T-cell epitope polypeptide comprises one or more HCV $CD8^+$ T cell epitopes. In some cases, the HCV T-cell epitope polypeptide comprises a single HCV-NS5A $CD8^+$ T-cell epitope. In some cases, the HCV T-cell epitope polypeptide comprises 2 or more HCV-NS5A $CD8^+$ T-cell epitopes. In some cases, the HCV T-cell epitope polypeptide comprises at least one HCV $CD4^+$ T cell epitope and at least one HCV $CD8^+$ T cell epitope. In some cases, the HCV T-cell epitope polypeptide comprises at least one HCV-NS5A $CD4^+$ T cell epitope and at least one HCV-NS5A $CD8^+$ T cell epitope. In some cases, HCV T-cell epitope polypeptide comprises 2 or more HCV-NS5A $CD4^+$ T-cell epitopes and 2 or more HCV-NS5A $CD8^+$ T-cell epitopes. In some cases, the HCV T-cell epitope polypeptide comprises 2, 3, 4, or 5 HCV-NS5A $CD4^+$ T-cell epitopes and 2, 3, 4, or 5 HCV-NS5A $CD8^+$ T-cell epitopes.

In some cases, the HCV T-cell epitope polypeptide comprises a single T-cell epitope. In some cases, the HCV T-cell epitope polypeptide comprises a single HCV-NS5B T-cell epitope. In some cases, the HCV T-cell epitope polypeptide comprises 2 or more T-cell epitopes. In some cases, the HCV T-cell epitope polypeptide comprises 2 or more HCV-NS5B T-cell epitopes. In some cases, the HCV T-cell epitope polypeptide comprises 3 or more HCV-NS5B T-cell epitopes. In some cases, the HCV T-cell epitope polypeptide comprises 4 or more HCV-NS5B T-cell epitopes. In some cases, the HCV T-cell epitope polypeptide comprises a single HCV-NS5B $CD4^+$ T-cell epitope. In some cases, the HCV T-cell epitope polypeptide comprises 2 or more HCV-NS5B $CD4^+$ T-cell epitopes. In some cases, the HCV T-cell epitope polypeptide comprises one or more HCV $CD8^+$ T cell epitopes. In some cases, the HCV T-cell epitope polypeptide comprises a single HCV-NS5B $CD8^+$ T-cell epitope. In some cases, the HCV T-cell epitope polypeptide comprises 2 or more HCV-NS5B $CD8^+$ T-cell epitopes. In some cases, the HCV T-cell epitope polypeptide comprises at least one HCV $CD4^+$ T cell epitope and at least one HCV $CD8^+$ T cell epitope. In some cases, the HCV T-cell epitope polypeptide comprises at least one HCV-NS5B $CD4^+$ T cell epitope and at least one HCV-NS5B $CD8^+$ T cell epitope. In some cases, HCV T-cell epitope polypeptide comprises 2 or more HCV-NS5B $CD4^+$ T-cell epitopes and 2 or more HCV-NS5B $CD8^+$ T-cell epitopes. In some cases, the HCV T-cell epitope polypeptide comprises 2, 3, 4, or 5 HCV-NS5B $CD4^+$ T-cell epitopes and 2, 3, 4, or 5 HCV-NS5B $CD8^+$ T-cell epitopes.

In some cases, the HCV T-cell epitope polypeptide comprises a single T-cell epitope. In some cases, the HCV T-cell epitope polypeptide comprises a single HCV-core T-cell epitope. In some cases, the HCV T-cell epitope polypeptide comprises 2 or more T-cell epitopes. In some cases, the HCV T-cell epitope polypeptide comprises 2 or more HCV-core T-cell epitopes. In some cases, the HCV T-cell epitope polypeptide comprises 3 or more HCV-core T-cell epitopes. In some cases, the HCV T-cell epitope polypeptide comprises 4 or more HCV-core T-cell epitopes. In some cases, the HCV T-cell epitope polypeptide comprises a single HCV-core $CD4^+$ T-cell epitope. In some cases, the HCV T-cell epitope polypeptide comprises 2 or more HCV-core $CD4^+$ T-cell epitopes. In some cases, the HCV T-cell epitope polypeptide comprises one or more HCV $CD8^+$ T cell epitopes. In some cases, the HCV T-cell epitope polypeptide comprises a single HCV-core $CD8^+$ T-cell epitope. In some cases, the HCV T-cell epitope polypeptide comprises 2 or more HCV-core $CD8^+$ T-cell epitopes. In some cases, the HCV T-cell epitope polypeptide comprises at least one HCV $CD4^+$ T cell epitope and at least one HCV $CD8^+$ T cell epitope. In some cases, the HCV T-cell epitope polypeptide comprises at least one HCV-core $CD4^+$ T cell epitope and at least one HCV-core $CD8^+$ T cell epitope. In some cases, HCV T-cell epitope polypeptide comprises 2 or more HCV-core $CD4^+$ T-cell epitopes and 2 or more HCV-core $CD8^+$ T-cell epitopes. In some cases, the HCV T-cell epitope polypeptide comprises 2, 3, 4, or 5 HCV-core $CD4^+$ T-cell epitopes and 2, 3, 4, or 5 HCV-core $CD8^+$ T-cell epitopes.

In some cases, the HCV T-cell epitope polypeptide comprises a single T-cell epitope. In some cases, the HCV T-cell epitope polypeptide comprises a single HCV-p7 T-cell epitope. In some cases, the HCV T-cell epitope polypeptide comprises 2 or more T-cell epitopes. In some cases, the HCV T-cell epitope polypeptide comprises 2 or more HCV-p7 T-cell epitopes. In some cases, the HCV T-cell epitope polypeptide comprises 3 or more HCV-p7 T-cell epitopes. In some cases, the HCV T-cell epitope polypeptide comprises 4 or more HCV-p7 T-cell epitopes. In some cases, the HCV T-cell epitope polypeptide comprises a single HCV-p7 $CD4^+$ T-cell epitope. In some cases, the HCV T-cell epitope polypeptide comprises 2 or more HCV-core $CD4^+$ T-cell epitopes. In some cases, the HCV T-cell epitope polypeptide comprises one or more HCV $CD8^+$ T cell epitopes. In some cases, the HCV T-cell epitope polypeptide comprises a single HCV-p7 $CD8^+$ T-cell epitope. In some cases, the HCV T-cell epitope polypeptide comprises 2 or more HCV-p7 $CD8^+$ T-cell epitopes. In some cases, the HCV T-cell epitope polypeptide comprises at least one HCV $CD4^+$ T cell epitope and at least one HCV $CD8^+$ T cell epitope. In some cases, the HCV T-cell epitope polypeptide comprises at least one HCV-p7 $CD4^+$ T cell epitope and at least one HCV-p7 $CD8^+$ T cell epitope. In some cases, HCV T-cell epitope polypeptide comprises 2 or more HCV-p7 $CD4^+$ T-cell epitopes and 2 or more HCV-p7 $CD8^+$ T-cell epitopes. In some cases, the HCV T-cell epitope polypeptide comprises 2, 3, 4, or 5 HCV-p7 $CD4^+$ T-cell epitopes and 2, 3, 4, or 5 HCV-p7 $CD8^+$ T-cell epitopes.

In some cases, the HCV T-cell epitope polypeptide comprises 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, or 63, of the T-cell epitopes set out in FIG. 9A-9B. In some cases, the HCV T-cell epitope polypeptide comprises from 1 to 3, from 3 to 5, from 5 to 10, from 10 to 15, from 15 to 20, from 20 to 25, or from 25 to 30 of the T-cell epitopes set out in FIG. 9A-9B. For example, in some cases, the HCV T-cell epitope polypeptide comprises the T-cell epitopes designated NS3-3, NS3-4, and NS3-11 in FIG. 9A-9B and FIG. 11A-11N. As another example, in some cases, the HCV T-cell epitope polypeptide comprises the T-cell epitopes designated NS2-1, NS2-2, NS2-3, NS2-7, and NS2-8 in FIG. 9A-9B and FIG. 11A-11N. As another example, in some cases, the HCV T-cell epitope polypeptide comprises the T-cell epitopes designated NS3-3, NS3-4, NS3-5, and NS3-11 in FIG. 9A-9B and FIG. 11A-11N. As another example, in some cases, the HCV T-cell epitope polypeptide comprises the T-cell epitopes designated NS3-3, NS3-4, NS3-5, NS3-6, NS3-7, NS3-11, NS3-12, and NS3-13 in FIG. 9A-9B and FIG. 11A-11N. As another example, in some cases, the HCV T-cell epitope polypeptide comprises the T-cell epitopes designated NS3-3, NS3-4, NS3-5, NS3-6, NS3-7, NS3-10, NS3-11, NS3-12, and NS3-13 in FIG. 9A-9B and FIG. 11A-11N. As another example, in some cases, the HCV T-cell epitope polypeptide comprises the T-cell epitopes designated Core-1, Core-2, Core-3, Core-4, Core-5, Core-6, Core-7, Core-8, Core-9, Core-10, Core-11, Core-12, Core-13, Core-14, Core-16, Core-17, Core-18, Core-19, Core-20, Core-21, and Core-22 in FIG. 9A-9B and FIG. 11A-11N. As another example, in some cases, the HCV T-cell epitope polypeptide comprises the T-cell epitopes designated NS3-1, NS3-2, NS3-3, NS3-4, NS3-5, NS3-6, NS3-7, NS3-9, NS3-10, NS3-11, NS3-12, and NS3-13 in FIG. 9A-9B and FIG. 11A-11N. As another example, in some cases, the HCV T-cell epitope polypeptide comprises the T-cell epitopes designated NS2-1, NS2-2, NS2-3, NS2-4, NS2-5, NS2-6, NS2-7, NS2-8, NS3-1, NS3-2, NS3-3, NS3-4, NS3-5, NS3-6, NS3-7, NS3-9, NS3-10, NS3-11, NS3-12, and NS3-13 in FIG. 9A-9B and FIG. 11A-11N. As another example, in some cases, the HCV T-cell epitope polypeptide comprises the T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, and NS4b-10 in FIG. 9A-9B and FIG. 11A-11N. As another example, in some cases, the HCV T-cell epitope polypeptide comprises the T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10, NS5a-1, NS5a-2, NS5b-1, and NS5b-2 in FIG. 9A-9B and FIG. 11A-11N. In some cases, the T-cell epitopes are contiguous. In some cases, any two T-cell epitopes are separated by linkers (e.g., a linker having a length of from 1 amino acid to about 50 amino acids, e.g., from 1 amino acid to 5 amino acids (aa), from 5 aa to 10 aa, from 10 aa to 15 aa, from 15 aa to 20 aa, from 20 aa to 25 aa, from 25 aa to 30 aa, from 30 aa to 40 aa, or from 40 aa to 50 aa).

In some cases, the HCV T-cell epitope polypeptide comprises at least one HCV $CD4^+$ T cell epitope and at least one HCV $CD8^+$ T cell epitope, where epitopes are conserved among HCV genotypes 1 and 2. In some cases, the HCV T-cell epitope polypeptide comprises at least one HCV $CD4^+$ T cell epitope and at least one HCV $CD8^+$ T cell epitope, where epitopes are conserved among HCV genotypes 1 and 3. In some cases, the HCV T-cell epitope polypeptide comprises at least one HCV $CD4^+$ T cell epitope and at least one HCV $CD8^+$ T cell epitope, where epitopes are conserved among HCV genotypes 1, 2, and 3. In some cases, the HCV T-cell epitope polypeptide comprises at least one HCV $CD4^+$ T cell epitope and at least one HCV $CD8^+$ T cell epitope, where epitopes are conserved among HCV genotypes 1, 2, 3, and 7. In some cases, the HCV T-cell epitope polypeptide comprises at least one HCV $CD4^+$ T cell epitope and at least one HCV $CD8^+$ T cell epitope, where epitopes are conserved among HCV genotypes 1-7.

The HCV T-cell epitope polypeptide can have a length of from about 10 amino acids to about 2000 amino acids; e.g., the HCV T-cell epitope polypeptide can have a length of from 10 amino acids (aa) to 15 aa, from 15 aa to 20 aa, from 20 aa to 25 aa, from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The HCV T-cell epitope polypeptide can have a length of from about 25 amino acids to about 2000 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 500 aa, from 500 aa to 600 aa, from 600 aa to 700 aa, from 700 aa to 800 aa, from 800 aa to 900 aa, from 900 aa to 1000 aa, from 1000 aa to 1100 aa, from 1100 aa to 1200 aa, from 1200 aa to 1300 aa, from 1300 aa to 1400 aa, from 1400 aa to 1500 aa, from 1500 aa to 1600 aa, from 1600 aa to 1700 aa, from 1700 aa to 1800 aa, from 1800 aa to 1900 aa, or from 1900 aa to 2000 aa. The HCV T-cell epitope polypeptide can have a length of from about 25 amino acids to about 3000 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 500 aa, from 500 aa to 600 aa, from 600 aa to 700 aa, from 700 aa to 800 aa, from 800 aa to 900 aa, from 900 aa to 1000 aa, from 1000 aa to 1100 aa, from 1100 aa to 1200 aa, from 1200 aa to 1300 aa, from 1300 aa to 1400 aa, from 1400 aa to 1500 aa, from 1500 aa to 1600 aa, from 1600 aa to 1700 aa, from 1700 aa to 1800 aa, from 1800 aa to 1900 aa, from 1900 aa to 2000 aa, from 2000 aa to 2250 aa, from 2250 aa to 2500 aa, from 2500 aa to 2750 aa, or from 2750 aa to 3000 aa.

The HCV T-cell epitope polypeptide can have a length of from about 25 amino acids to about 800 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The HCV T-cell epitope polypeptide can have a length of from about 25 amino acids to about 400 amino acids, e.g., from about 25 amino acids (aa) to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, or from 350 aa to 400 aa. The HCV T-cell epitope polypeptide can have a length of 25 amino acids (aa), 26 aa, 27 aa, 28 aa, 29 aa, 30 aa, 31 aa, 32 aa, 33 aa, 34 aa, 35 aa, 36 aa, 37 aa, 38 aa, 39 aa, 40 aa, 41 aa, 42 aa, 43 aa, 44 aa, 45 aa, 46 aa, 47 aa, 48 aa, 49 aa, or 50 aa. The HCV T-cell epitope polypeptide can have a length of from about 100 amino acids (aa) to 800 aa, e.g., from 100 aa to 150 aa, from 150 aa to 200 aa, from 200 aa to 250 aa, from 250 aa to 300 aa, from 300 aa to 350 aa, from 350 aa to 400 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 800 aa. The HCV T-cell epitope polypeptide can have a length of from 25 aa to 30 aa. The HCV T-cell epitope polypeptide can have a length of from 30 aa to 40 aa. The HCV T-cell epitope polypeptide can have a length of from 40 aa to 50 aa. The HCV T-cell epitope polypeptide can have a length of from 50 aa to 60 aa (e.g., 50 aa, 51 aa, 52, aa, 53 aa, 54 aa, 55 aa, 56 aa, 57 aa, 58 aa, 59 aa, or 60 aa). The HCV T-cell epitope polypeptide can have a length of from 60 aa to 70 aa. The HCV T-cell epitope polypeptide can have a length of from 65 aa to 75 aa (e.g., 65, 66, 67, 68, 69, 70, 71, 72, 7, 74, or 75 aa). The HCV T-cell epitope polypeptide can have a length of 70 aa. The HCV T-cell epitope polypeptide can have a length of from 70 aa to 80 aa. The HCV T-cell epitope polypeptide can have a length of from 80 aa to 90 aa. The HCV T-cell epitope polypeptide can have a length of from 90 aa to 100 aa. The HCV T-cell epitope polypeptide can have a length of from 100 aa to 105 aa (e.g., 100, 101, 102, 103, 104, 105, 106, 107, 108, 109, or 110 aa). The HCV T-cell epitope polypeptide can have a length of 100 aa. The HCV T-cell epitope polypeptide can have a length of from 10 amino acids (aa) to 50 aa; e.g., from 10 aa to 15 aa, from 15 aa to 20 aa, from 20 aa to 25 aa, from 25 aa to 30 aa, from 30 aa to 35 aa, from 35 aa to 40 aa, from 40 aa to 45 aa, or from 45 aa to 50 aa. The HCV T-cell epitope polypeptide can have a length of from 10 amino acids (aa) to 20 aa, e.g., 10, 11, 12, 13, 14, 15, 16, 17, 18, 19, or 20 aa.

HCV NS3 T-Cell Epitopes

In some cases, the HCV T-cell epitope polypeptide includes one or more T-cell epitopes present in an HCV NS3 polypeptide. Examples of T-cell epitopes present in NS3 polypeptides are depicted in FIG. 11A-11N, FIG. 9B, and FIG. 10A-10B.

The HCV T-cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKL (SEQ ID NO:94). AIPLEVIKGGRHLIFCHSKKKCDE-LAAKL (SEQ ID NO:94) is referred to in FIG. 10A as "TP29." In some cases, the HCV T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHS-KKKCDELAAKL (SEQ ID NO:94); and has a length of from 25 aa to 35 aa (e.g., 25 aa, 26 aa, 27 aa, 28 aa, 29 aa, 30 aa, 31 aa, 32 aa, 33 aa, 34 aa, or 35 aa). In some cases, the HCV T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAKL (SEQ ID NO:94); and has a length of 29 amino acids. Such a polypeptide can include NS3 T-cell epitopes designated NS3-3, NS3-4, and NS3-11 in FIG. 9B and FIG. 11A-11N.

The HCV T-cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEVIKGGRHLIFCHSKKKCDELAAK-LVALGINAVAYYRGLDVSVIPTSG (SEQ ID NO:95). AIPLEVIKGGRHLIFCHSKKKCDELAAKLVALGI-NAVAYYRGLDVSVIPTSG (SEQ ID NO:95) is referred to in FIG. 10A as "TP52." In some cases, the HCV T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEV-IKGGRHLIFCHSKKKCDELAAKLVALGINAVAYYR-GLDVSVIPTSG (SEQ ID NO:95); and has a length of from 45 amino acids to 60 amino acids (e.g., 45 aa, 46 aa, 47 aa, 48 aa, 49 aa, 50 aa, 51 aa, 52 aa, 53 aa, 54 aa, 55 aa, 56 aa, 57 aa, 58 aa, 59 aa, or 60 aa). In some cases, the HCV T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: AIPLEV-IKGGRHLIFCHSKKKCDELAAKLVALGINAVAYYR-GLDVSVIPTSG (SEQ ID NO:95); and has a length of 52 amino acids. Such a polypeptide can include NS3 T-cell epitopes designated NS3-3, NS3-4, NS3-5, and NS3-11 in FIG. 9B and FIG. 11A-11N The HCV T-cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: KGGRHLIFCHSKKKCDELAAKLVALGI-NAVAYYRGLDVSVIPTSGDVVVVATDALMTG FTGDFDSVIDCN (SEQ ID NO:96); and has a length of from 65 amino acids to 80 amino acids (e.g., 65 aa, 66 aa, 67 aa, 68 aa, 69 aa, 70 aa, 71 aa, 72 aa, 73 aa, 74 aa, 75 aa, 76 aa, 77 aa, 78 aa, 79 aa, or 80 aa). KGGRHLIFCHS-KKKCDELAAKLVALGINAVAYYR-GLDVSVIPTSGDVVVVATDALMTG FTGDFDSVIDCN (SEQ ID NO:96) is referred to in FIG. 10A as "TP70."

In some cases, the HCV T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: KGGRHLIFCHSKKKCDELAAKLVALGI-NAVAYYRGLDVSVIPTSGDVVVVATDALMTG FTGDFDSVIDCN (SEQ ID NO:96); and has a length of 70 amino acids. Such a polypeptide can include NS3 T-cell epitopes designated NS3-3, NS3-4, NS3-5, NS3-6, NS3-7, NS3-11, NS3-12, and NS3-13 in FIG. 9B and FIG. 11A-11N.

The HCV T-cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: VALSTTGEIPFYGKAIPLEVIKGGRHLIFCHS-KKKCDELAAKLVALGINAVAYYRGLDVS VIPTSGDVVV-VATDALMTGFTGDFDSVIDCNTCVTQTVDF (SEQ ID NO:97); and has a length of from 95 amino acids (aa) to 105 aa (e.g., 95 aa, 96 aa, 97 aa, 98 aa, 99 aa, 100 aa, 101 aa, 102 aa, 103 aa, 104 aa, or 105 aa). VALSTTGEIPFYGKAIPLE-VIKGGRHLIFCHSKKKCDELAAKLVALGINAVAYYR-GLDVS VIPTSGDVVV-VATDALMTGFTGDFDSVIDCNTCVTQTVDF (SEQ ID NO:97) is referred to in FIG. 10A as "TP100."

In some cases, the HCV T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: VALSTTGEIPFYGKAIPLEVIKG- GRHLIFCHSKKKCDELAAKLVALGINAVAYYRGLDVS VIPTSGDVVV-VATDALMTGFTGDFDSVIDCNTCVTQTVDF (SEQ ID NO:97); and has a length of 100 amino acids. Such a polypeptide can include NS3 T-cell epitopes designated NS3-3, NS3-4, NS3-5, NS3-6, NS3-7, NS3-10, NS3-11, NS3-12, and NS3-13 in FIG. 9B and FIG. 11A-11N.

The HCV T-cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRN-TNRRPQDVKFPGGGQIVGGVYLL-PRRGPRLGVRATRKTSERSQP RGRRQPIPKARRPE-GRTWAQPGYPWPLYGNEGCGWAGWLLSPRGSRPS WGPTDPRRRS RNLGKVIDTLTCGFADLMGYIPLVGAPLGGAARAL-AHGVRVLEDGVNYATGNLPG (SEQ ID NO:89); and has a length of from 171 amino acids (aa) to 180 aa (e.g., 171 aa, 172 aa, 173 aa, 174 aa, 175 aa, 176 aa, 177 aa, 178 aa, 179 aa, or 180 aa. MSTNPKPQRKTKRN-TNRRPQDVKFPGGGQIVGGVYLL-PRRGPRLGVRATRKTSERSQP RGRRQPIPKARRPE-GRTWAQPGYPWPLYGNEGCGWAGWLLSPRGSRPS WGPTDPRRRS RNLGKVIDTLTCGFADLMGYIPLVGAPLGGAARAL-AHGVRVLEDGVNYATGNLPG (SEQ ID NO:89) is referred to in FIG. 10A as “TP171.”

In some cases, the HCV T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRN-TNRRPQDVKFPGGGQIVGGVYLL-PRRGPRLGVRATRKTSERSQP RGRRQPIPKARRPE-GRTWAQPGYPWPLYGNEGCGWAGWLLSPRGSRPSW GPTDPRRRS RNLGKVIDTLTCGFADLMGYIPLVGAPLGGAARAL-AHGVRVLEDGVNYATGNLPG (SEQ ID NO:89); and has a length of 171 amino acids.

The HCV T-cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRN-TNRRPQDVKFPGGGQIVGGVYLL-PRRGPRLGVRATRKTSERSQP RGRRQPIPKARRPE-GRTWAQPGYPWPLYGNEGCGWAGWLLSPRGSRPS WGPTDPRRRS RNLGKVIDTLTCGFADLMGYIPLVGAPLGGAARAL-AHGVRVLEDGVNYATGNLPGCSF SIFL-LALLSCLTVPASA (SEQ ID NO:98); and has a length of from 190 amino acids (aa) to 200 aa (e.g., 190 aa, 191 aa, 192 aa, 193 aa, 194 aa, 195 aa, 196 aa, 197 aa, 198 aa, 199 aa, or 200 aa.

In some cases, the HCV T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRN-TNRRPQDVKFPGGGQIVGGVYLL-PRRGPRLGVRATRKTSERSQP RGRRQPIPKARRPE-GRTWAQPGYPWPLYGNEGCGWAGWLLSPRGSRPS WGPTDPRRRS RNLGKVIDTLTCGFADLMGYIPLVGAPLGGAARAL-AHGVRVLEDGVNYATGNLPGCSF SIFL-LALLSCLTVPASA (SEQ ID NO:98); and has a length of 191 amino acids.

The HCV T-cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence:

```
                                              (SEQ ID NO: 81)
LHAPTGSGKSTKVPAAYAAQGYKVLVLNPSVAATLGFGAYMSKAHGIDPN

IRTGVRTITTGSPITYSTYGKFLADGGCSGGAYDIIICDECHSTDATSIL

GIGTVLDQAETAGARLVVLATATPPGSVTVPHPNIEEVALSTTGEIPFYG

KAIPLEVIKGGRHLIFCHSKKKCDELAAKLVALGINAVAYYRGLDVSVIP

TSGDVVVVATDALMTGFTGDFDSVIDCN;
```

and has a length of from 215 amino acids (aa) to 235 aa (e.g., 215 aa, 216 aa, 217 11, 218 aa, 219 aa, 220 aa, 221 aa, 222 aa, 223 aa, 224 aa, 225 aa, 226 aa, 227 aa, 228 aa, 229 aa, 230 aa, 231 aa, 232 aa, 233 aa, 234 aa, or 235 aa).

```
                                              (SEQ ID NO: 81)
LHAPTGSGKSTKVPAAYAAQGYKVLVLNPSVAATLGFGAYMSKAHGIDPN

IRTGVRTITTGSPITYSTYGKFLADGGCSGGAYDIIICDECHSTDATSIL

GIGTVLDQAETAGARLVVLATATPPGSVTVPHPNIEEVALSTTGEIPFYG

KAIPLEVIKGGRHLIFCHSKKKCDELAAKLVALGINAVAYYRGLDVSVIP

TSGDVVVVATDALMTGFTGDFDSVIDCN;
```

is referred to in FIG. 10A as “TP228.”

In some cases, the HCV T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence:

```
                                              (SEQ ID NO: 81)
LHAPTGSGKSTKVPAAYAAQGYKVLVLNPSVAATLGFGAYMSKAHGIDPN
```

-continued

```
IRTGVRTITTGSPITYSTYGKFLADGGCSGGAYDIIICDECHSTDATSIL

GIGTVLDQAETAGARLVVLATATPPGSVTVPHPNIEEVALSTTGEIPFYG

KAIPLEVIKGGRHLIFCHSKKKCDELAAKLVALGINAVAYYRGLDVSVIP

TSGDVVVVATDALMTGFTGDFDSVIDCN;
```

and has a length of 228 amino acids. Such a polypeptide can include NS3 T-cell epitopes designated NS3-1, NS3-2, NS3-3, NS3-4, NS3-5, NS3-6, NS3-7, NS3-9, NS3-10, NS3-11, NS3-12, and NS3-13 in FIG. 9B and FIG. 11A-11N.

As another example, the HCV T-cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1265-1279 of the amino acid sequence designated "Consensus" in FIG. 12A-12L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the HCV T-cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1309-1323 of the amino acid sequence designated "Consensus" in FIG. 12A-12L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the HCV T-cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1401-1415 of the amino acid sequence designated "Consensus" in FIG. 12A-12L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the HCV T-cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1402-1412 of the amino acid sequence designated "Consensus" in FIG. 12A-12L, or a corresponding HCV NS3 amino acid sequence of any HCV genotype; and the HCV NS3 T-cell epitope can have a length of from 11 amino acids (aa) to 16 amino acids (e.g., 11 aa, 12 aa, 13 aa, 14 aa, 15 aa, or 16 aa).

As another example, the HCV T-cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1429-1439 of the amino acid sequence designated "Consensus" in FIG. 12A-12L, or a corresponding HCV NS3 amino acid sequence of any HCV genotype; and the HCV NS3 T-cell epitope can have a length of from 11 amino acids (aa) to 16 amino acids (e.g., 11 aa, 12 aa, 13 aa, 14 aa, 15 aa, or 16 aa).

As another example, the HCV T-cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1450-1464 of the amino acid sequence designated "Consensus" in FIG. 12A-12L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the HCV T-cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1453-1467 of the amino acid sequence designated "Consensus" in FIG. 12A-12L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the HCV T-cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1577-1591 of the amino acid sequence designated "Consensus" in FIG. 12A-12L, or a corresponding HCV NS3 amino acid sequence of any HCV genotype; and the HCV NS3 T-cell epitope can have a length of from 15 amino acids (aa) to 20 amino acids (e.g., 15 aa, 16 aa, 17 aa, 18 aa, 19 aa, or 20 aa).

As another example, the HCV T-cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1306-1314 of the amino acid sequence designated "Consensus" in FIG. 12A-12L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the HCV T-cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1387-1394 of the amino acid sequence designated "Consensus" in FIG. 12A-12L, or a corresponding HCV NS3 amino acid sequence of any HCV genotype; and the HCV NS3 T-cell epitope can have a length of from 1 amino acids (aa) to 15 amino acids (e.g., 8 aa, 9 aa, 10 aa, 11 aa, 12 aa, 13 aa, 14 aa, or 15 aa).

As another example, the HCV T-cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1405-1413 of the amino acid sequence designated "Consensus" in FIG. 12A-12L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the HCV T-cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1450-1458 of the amino acid sequence designated "Consensus" in FIG. 12A-12L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the HCV T-cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1457-1465 of the amino acid sequence designated "Consensus" in FIG. 12A-12L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

As another example, the HCV T-cell epitope polypeptide can comprise an HCV NS3 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1610-1618 of the amino acid sequence designated "Consensus" in FIG. 12A-12L, or a corresponding HCV NS3 amino acid sequence of any HCV genotype; and the HCV NS3 T-cell epitope can have a length of from 9 amino acids (aa) to 15 amino acids (e.g., 9 aa, 10 aa, 11 aa, 12 aa, 13 aa, 14 aa, or 15 aa).

HCV NS2 T-Cell Epitopes

In some cases, the HCV T-cell epitope polypeptide includes one or more T-cell epitopes present in an HCV NS2 polypeptide. Examples of T-cell epitopes present in NS2 polypeptides are depicted in FIG. 11A-11N, and FIG. 9A.

For example, the HCV T-cell epitope polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 955-974 of the amino acid sequence designated "Consensus" in FIG. 12A-12L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the HCV T-cell epitope polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 975-994 of the amino acid sequence designated "Consensus" in FIG. 12A-12L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the HCV T-cell epitope polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 985-1004 of the amino acid sequence designated "Consensus" in FIG. 12A-12L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the HCV T-cell epitope polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1015-1034 of the amino acid sequence designated "Consensus" in FIG. 12A-12L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the HCV T-cell epitope polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1035-1054 of the amino acid sequence designated "Consensus" in FIG. 12A-12L, or a corresponding HCV NS2 amino acid sequence of any HCV genotype; and the NS2 T cell epitope can have a length of from 20 amino acids (aa) to 25 amino acids (e.g., 20 aa, 21 aa, 22 aa, 23 aa, 24 aa, or 25 aa).

As another example, the HCV T-cell epitope polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 924-933 of the amino acid sequence designated "Consensus" in FIG. 12A-12L, or a corresponding HCV NS2 amino acid sequence of any HCV genotype; and the NS2 T cell epitope can have a length of from 10 amino acids (aa) to 15 amino acids (e.g., 10 aa, 11 aa, 12 aa, 13 aa, 14 aa, or 15 aa).

As another example, the HCV T-cell epitope polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 961-970 of the amino acid sequence designated "Consensus" in FIG. 12A-12L, or a corresponding HCV NS2 amino acid sequence of any HCV genotype; and the NS2 T cell epitope can have a length of from 10 amino acids (aa) to 15 amino acids (e.g., 10 aa, 11 aa, 12 aa, 13 aa, 14 aa, or 15 aa).

As another example, the HCV T-cell epitope polypeptide can comprise an NS2 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 989-997 of the amino acid sequence designated "Consensus" in FIG. 12A-12L, or a corresponding HCV NS2 amino acid sequence of any HCV genotype; and the NS2 T cell epitope can have a length of from 9 amino acids (aa) to 15 amino acids (e.g., 9 aa, 10 aa, 11 aa, 12 aa, 13 aa, 14 aa, or 15 aa).

In some cases, the HCV T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 50 aa (e.g., from 10 aa to 25 aa, or from 25 aa to 50 aa) of amino acids 955-1004 of the amino acid sequence designated "Consensus" in FIG. 12A-12L, or a corresponding HCV NS2 amino acid sequence of any HCV genotype; and has a length of from 10 amino acids (aa) to 25 aa, or from 25 aa to 50 aa. In some cases, the HCV T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 955-1004 of the amino acid sequence designated "Consensus" in FIG. 12A-12L, or a corresponding HCV NS2 amino acid sequence of any HCV genotype; and has a length of about 50 amino acids.

In some cases, the HCV T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 553 aa (e.g., from 10 aa to 25 aa, from 25 aa to 50 aa, from 50 aa to 100 aa, from 100 aa to 200 aa, from 200 aa to 300 aa, from 300 aa to 400 aa, from 400 aa to 500 aa, or from 500 aa to 553 aa) of amino acids 917-1469 of the amino acid sequence designated "Consensus" in FIG. 12A-12L, or a corresponding HCV NS2 and NS3 amino acid sequence of any HCV genotype; and has a length of from 10 amino acids (aa) to 25 aa, from 25 aa to 50 aa, from 50 aa to 100 aa, from 100 aa to 200 aa, from 200 aa to 300 aa, from 300 aa to 400 aa, from 400 aa to 500 aa, or from 500 aa to 553 aa. In some cases, the HCV T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 917-1469 of the amino acid sequence designated "Consensus" in FIG. 12A-12L, or a corresponding HCV NS2 and NS3 amino acid sequence of any HCV genotype; and has a length of about 553 amino acids.

The HCV T-cell epitope polypeptide can comprise an amino acid sequence having at least about 20%, at least about 25%, at least about 30%, at least about 35%, at least about 40%, at least about 45%, at least about 50%, at least about 60%, at least about 0%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRDWAHNGLRDLA-VAVEPVVFSQMETKLITWGADT (SEQ ID NO:99). LGALTGTYVYNHLTPLRDWAHNGLRDLAVAVE-PVVFSQMETKLITWGADT (SEQ ID NO:99) is referred to in FIG. 10A as "TP50." In some cases, the HCV T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRDWAHNGLRDLAVAVE-PVVFSQMETKLITWGADT (SEQ ID NO:99); and has a length of from 50 amino acids to 60 amino acids (e.g., 50 aa, 51 aa, 52 aa, 53 aa, 54 aa, 55 aa, 56 aa, 57 aa, 58 aa, 59 aa, or 60 aa). In some cases, the HCV T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LGALTGTYVYNHLTPLRD-WAHNGLRDLAVAVEPVVFSQMETKLITWGADT (SEQ ID NO:99); and has a length of 50 amino acids. Such a polypeptide can include NS2 T-cell epitopes designated NS2-1, NS2-2, NS2-3, NS2-7, and NS2-8 in FIG. 9A and FIG. 11A-11N.

HCV NS4A T-Cell Epitopes

In some cases, the HCV T-cell epitope polypeptide includes one or more T-cell epitopes present in an HCV NS4A polypeptide. Examples of T-cell epitopes present in NS4A polypeptides are depicted in FIG. 11A-11N and FIG. 9B.

The HCV T-cell epitope polypeptide can comprise an NS4A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1683-1692 of the amino acid sequence designated "Consensus" in FIG. 12A-12L, or a corresponding HCV NS4A amino acid sequence of any HCV genotype; and the NS4A T-cell epitope can have a length of from 10 amino acids (aa) to 15 amino acids (e.g., 10 aa, 11 aa, 12 aa, 13 aa, 14 aa, or 15 aa).

HCV NS4B T-Cell Epitopes

In some cases, the HCV T-cell epitope polypeptide includes one or more T-cell epitopes present in an HCV NS4B polypeptide. Examples of T-cell epitopes present in NS4B polypeptides are depicted in FIG. 11A-11N and FIG. 9B.

As one example, the HCV T-cell epitope polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1790-1801 of the amino acid sequence designated "Consensus" in FIG. 12A-12L, or a corresponding HCV NS4B amino acid sequence of any HCV genotype; and the NS4B T-cell epitope can have a length of from 12 amino acids (aa) to 20 amino acids (e.g., 12 aa, 13 aa, 14 aa, 15 aa, 16 aa, 17 aa, 18 aa, 19 aa, or 20 aa).

As another example, the HCV T-cell epitope polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1792-1802 of the amino acid sequence designated "Consensus" in FIG. 12A-12L, or a corresponding HCV NS4B amino acid sequence of any HCV genotype; and the NS4B T-cell epitope can have a length of from 11 amino acids (aa) to 20 amino acids (e.g., 11 aa, 12 aa, 13 aa, 14 aa, 15 aa, 16 aa, 17 aa, 18 aa, 19 aa, or 20 aa).

As another example, the HCV T-cell epitope polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1898-1905 of the amino acid sequence designated "Consensus" in FIG. 12A-12L, or a corresponding HCV NS4B amino acid sequence of any HCV genotype; and the NS4B T-cell epitope can have a length of from 8 amino acids (aa) to 15 amino acids (e.g., 8 aa, 9 aa, 10 aa, 11 aa, 12 aa, 13 aa, 14 aa, or 15 aa).

As another example, the HCV T-cell epitope polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1921-1935 of the amino acid sequence designated "Consensus" in FIG. 12A-12L, or a corresponding HCV NS4B amino acid sequence of any HCV genotype; and the NS4B T-cell epitope can have a length of from 15 amino acids (aa) to 20 amino acids (e.g., 15 aa, 16 aa, 17 aa, 18 aa, 19 aa, or 20 aa).

As another example, the HCV T-cell epitope polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1922-1941 of the amino acid sequence designated "Consensus" in FIG. 12A-12L, or a corresponding HCV NS4B amino acid sequence of any HCV genotype; and the NS4B T-cell epitope can have a length of from 20 amino acids (aa) to 25 amino acids (e.g., 20 aa, 21 aa, 22 aa, 23 aa, 24 aa, or 25 aa).

As another example, the HCV T-cell epitope polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1928-1947 of the amino acid sequence designated "Consensus" in FIG. 12A-12L, or a corresponding HCV NS4B amino acid sequence of any HCV genotype; and the NS4B T-cell epitope can have a length of from 20 amino acids (aa) to 25 amino acids (e.g., 20 aa, 21 aa, 22 aa, 23 aa, 24 aa, or 25 aa).

As another example, the HCV T-cell epitope polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1868-1876 of the amino acid sequence designated "Consensus" in FIG. 12A-12L, or a corresponding HCV NS4B amino acid sequence of any HCV genotype; and the NS4B T-cell epitope can have a length of from 9 amino acids (aa) to 15 amino acids (e.g., 9 aa, 10 aa, 11 aa, 12 aa, 13 aa, 14 aa, or 15 aa).

As another example, the HCV T-cell epitope polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1927-1942 of the amino acid sequence designated "Consensus" in FIG. 12A-12L, or a corresponding HCV NS4B amino acid sequence of any HCV genotype; and the NS4B T-cell epitope can have a length of from 16 amino acids (aa) to 20 amino acids (e.g., 16 aa, 17 aa, 18 aa, 19 aa, or 20 aa).

As another example, the HCV T-cell epitope polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1932-1940 of the amino acid sequence designated "Consensus" in FIG. 12A-12L, or a corresponding HCV NS4B amino acid sequence of any HCV genotype; and the NS4B T-cell epitope can have a length of from 9 amino acids (aa) to 15 amino acids (e.g., 9 aa, 10 aa, 11 aa, 12 aa, 13 aa, 14 aa, or 15 aa).

As another example, the HCV T-cell epitope polypeptide can comprise an NS4B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1948-1962 of the amino acid sequence designated "Consensus" in FIG. 12A-12L, or a corresponding HCV NS4B amino acid sequence of any HCV genotype; and the NS4B T-cell epitope can have a length of from 15 amino acids (aa) to 20 amino acids (e.g., 15 aa, 16 aa, 17 aa, 18 aa, 19 aa, or 20 aa).

HCV NS5A T-Cell Epitopes

In some cases, the HCV T-cell epitope polypeptide includes one or more T-cell epitopes present in an HCV NS5A polypeptide. Examples of T-cell epitopes present in NS5A polypeptides are depicted in FIG. 11A-11N and FIG. 9B.

As one example, the HCV T-cell epitope polypeptide can comprise an NS5A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2218-2232 of the amino acid sequence designated "Consensus" in FIG. 12A-12L, or a corresponding HCV NS5A amino acid sequence of any HCV genotype; and the NS5A T-cell epitope can have a length of from 15 amino acids (aa) to 20 amino acids (e.g., 15 aa, 16 aa, 17 aa, 18 aa, 19 aa, or 20 aa).

As another example, the HCV T-cell epitope polypeptide can comprise an NS5A T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2309-2317 of the amino acid sequence designated "Consensus" in FIG. 12A-12L, or a corresponding HCV NS5A amino acid sequence of any HCV genotype; and the NS5A T-cell epitope can have a length of from 9 amino acids (aa) to 15 amino acids (e.g., 9 aa, 10 aa, 11 aa, 12 aa, 13 aa, 14 aa, or 15 aa).

HCV NS5B T-Cell Epitopes

In some cases, the HCV T-cell epitope polypeptide includes one or more T-cell epitopes present in an HCV NS5B polypeptide. Examples of T-cell epitopes present in NS5B polypeptides are depicted in FIG. 11A-11N and FIG. 9B.

As one example, the HCV T-cell epitope polypeptide can comprise an NS5B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2847-2851 of the amino acid sequence designated "Consensus" in FIG. 12A-12L, or a corresponding HCV NS5B amino acid sequence of any HCV genotype; and the NS5B T-cell epitope can have a length of from 5 amino acids (aa) to 10 amino acids (e.g., 5 aa, 6 aa, 7 aa, 8 aa, 9 aa, or 10 aa).

As another example, the HCV T-cell epitope polypeptide can comprise an NS5B T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 2602-2610 of the amino acid sequence designated "Consensus" in FIG. 12A-12L, or a corresponding HCV NS5B amino acid sequence of any HCV genotype; and the NS5B T-cell epitope can have a length of from 9 amino acids (aa) to 15 amino acids (e.g., 9 aa, 10 aa, 11 aa, 12 aa, 13 aa, 14 aa, or 15 aa).

HCV Core T-Cell Epitopes

In some cases, the HCV T-cell epitope polypeptide includes one or more T-cell epitopes present in an HCV core polypeptide. Examples of T-cell epitopes present in HCV Core polypeptides are depicted in FIG. 11A-11N and FIG. 9A.

As one example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1-20 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 11-30 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 21-40 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 39-63 of the amino acid sequence designated "Consensus" in FIG. 12A-12L, or a corresponding HCV core amino acid sequence of any HCV genotype; and the HCV core T-cell epitope can have a length of from 23 amino acids (aa) to 28 amino acids (e.g., 23 aa, 24 aa, 25 aa, 26 aa, 27 aa, or 28 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 47-70 of the amino acid sequence designated "Consensus" in FIG. 12A-12L, or a corresponding HCV core amino acid sequence of any HCV genotype; and the HCV core T-cell epitope can have a length of from 24 amino acids (aa) to 29 amino acids (e.g., 24 aa, 25 aa, 26 aa, 27 aa, 28 aa, or 29 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 61-80 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 71-90 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 81-100 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 91-110 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 101-115 of the amino acid sequence designated "Consensus" in FIG. 12A-12L, or a corresponding HCV core amino acid sequence of any HCV genotype; and the HCV core T-cell epitope can have a length of from 15 amino acids (aa) to 20 amino acids (e.g., 15 aa, 16 aa, 17 aa, 18 aa, 19 aa, or 20 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 111-130 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 125-139 of the amino acid sequence designated "Consensus" in FIG. 12A-12L, or a corresponding HCV core amino acid sequence of any HCV genotype; and the HCV core T-cell epitope can have a length of from 15 amino acids (aa) to 20 amino acids (e.g., 15 aa, 16 aa, 17 aa, 18 aa, 19 aa, or 20 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 131-150 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 151-170 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 161-180 of the amino acid sequence designated "Consensus" in FIG. 12A-12L, or a corresponding HCV core amino acid sequence of any HCV genotype; and the HCV core T-cell epitope can have a length of from 20 amino acids (aa) to 25 amino acids (e.g., 20 aa, 21 aa, 22 aa, 23 aa, 24 aa, or 25 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 35-44 of the amino acid sequence designated "Consensus" in FIG. 12A-12L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 43-51 of the amino acid sequence designated "Consensus" in FIG. 12A-12L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 51-59 of the amino acid sequence designated "Consensus" in FIG. 12A-12L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 129-137 of the amino acid sequence designated "Consensus" in FIG. 12A-12L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 131-140 of the amino acid sequence designated "Consensus" in FIG. 12A-12L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 150-158 of the amino acid sequence designated "Consensus" in FIG. 12A-12L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 154-162 of the amino acid sequence designated "Consensus" in FIG. 12A-12L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 168-176 of the amino acid sequence designated "Consensus" in FIG. 12A-12L, or a corresponding HCV core amino acid sequence of any HCV genotype; and the HCV core T-cell epitope can have a length of from 9 amino acids (aa) to 15 amino acids (e.g., 9 aa, 10 aa, 11 aa, 12 aa, 13 aa, 14 aa, or 15 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 177-187 of the amino acid sequence designated "Consensus" in FIG. 12A-12L, or a corresponding HCV core amino acid sequence of any HCV genotype; and the HCV core T-cell epitope can have a length of from 11 amino acids (aa) to 16 amino acids (e.g., 11 aa, 12 aa, 13 aa, 14 aa, 15 aa, or 16 aa).

As another example, the HCV T-cell epitope polypeptide can comprise an HCV core T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 178-187 of the amino acid sequence designated "Consensus" in FIG. 12A-12L, or a corresponding HCV core amino acid sequence of any HCV genotype; and the HCV core T-cell epitope can have a length of from 10 amino acids (aa) to 15 amino acids (e.g., 10 aa, 11 aa, 12 aa, 13 aa, 14 aa, or 15 aa).

In some cases, the HCV T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 10 amino acids (aa) to 191 aa (e.g., from 10 aa to 25 aa, from 25 aa to 50 aa, from 50 aa to 75 aa, from 75 aa to 100 aa, from 100 aa to 150 aa, or from 150 aa to 191aa) of amino acids 1-191 of the amino acid sequence designated "Consensus" in FIG. 12A-12L, or a corresponding HCV core amino acid sequence of any HCV genotype; and has a length of from 10 amino acids (aa) to 25 aa, from 25 aa to 50 aa, from 50 aa to 100 aa, or from 100 aa to 150 aa, or from 150 aa to 191 aa. In some cases, the HCV T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 1-191 of the amino acid sequence designated "Consensus" in FIG. 12A-12L, or a corresponding HCV core amino acid sequence of any HCV genotype; and has a length of about 191 amino acids.

The HCV T-cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRN-TNRRPQDVKFPGGGQIVGGVYLL-PRRGPRLGVRATRKTSERSQP RGRRQPIPKARRPE-GRTWAQPGYPWPLYGNEGCGWAGWLLSPRGSRPS WGPTDPRRRS RNLGKVIDTLTCGFADLMGYIPLVGAPLGGAARAL-AHGVRVLEDGVNYATGNLPG (SEQ ID NO:97); and has a length of from 171 amino acids (aa) to 180 aa (e.g., 171 aa, 172 aa, 173 aa, 174 aa, 175 aa, 176 aa, 177 aa, 178 aa, 179 aa, or 180 aa). In some cases, the HCV T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: MSTNPKPQRKTKRN-TNRRPQDVKFPGGGQIVGGVYLL-PRRGPRLGVRATRKTSERSQP RGRRQPIPKARRPE-GRTWAQPGYPWPLYGNEGCGWAGWLLSPRGSRPS WGPTDPRRRS RNLGKVIDTLTCGFADLMGYIPLVGAPLGGAARAL-AHGVRVLEDGVNYATGNLPG (SEQ ID NO:97); and has a length of 171 amino acids. Such a polypeptide can include core T-cell epitopes designated Core-1, Core-2, Core-3, Core-4, Core-5, Core-6, Core-7, Core-8, Core-9, Core-10, Core-11, Core-12, Core-13, Core-14, Core-16, Core-17, Core-18, Core-19, Core-20, Core-21, Core-22 in FIG. 9A and FIG. 11A-11N.

HCV p7 T-Cell Epitopes

In some cases, the HCV T-cell epitope polypeptide includes one or more T-cell epitopes present in an HCV p7 polypeptide. Examples of T-cell epitopes present in HCV p7 polypeptides are depicted in FIG. 11A-11N or FIG. 9A.

As another example, the HCV T-cell epitope polypeptide can comprise an HCV p7 T cell epitope comprising an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to amino acids 803-811 of the amino acid sequence designated "Consensus" in FIG. 12A-12L, or a corresponding HCV p7 amino acid sequence of any HCV genotype; and the HCV p7 T-cell epitope can have a length of from 9 amino acids (aa) to 15 amino acids (e.g., 9 aa, 10 aa, 11 aa, 12 aa, 13 aa, 14 aa, or 15 aa).

HCV T-Cell Epitope Polypeptides Including HCV T-Cell Epitopes from More than One HCV Polypeptide Other than E1 and E2

As noted above, a HCV T-cell epitope polypeptide can include T-cell epitopes from more than one HCV polypeptide other than E1 and E2.

As one example, a HCV T-cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: QASLLKVPYFVRVQGLLRICA-LARKMAGGHYVQMAIIKLGALTGTYVYN ALTPLRDW AHNGLRDLAVAVEPVVFSQMETKLITW-GADTAACGDIINGLPVSARRGREILLGPADG MVSKGWRLLAPITAYAQQTRGLLGCIITSLT-GRDKNQVEGEVQIVSTAAQTFLATCING VCWTVYHGAGTRTIAS-PKGPVIQMYTNVDQDLVGW-PAPQGARSLTPCTCGSSDLYLVT RHAD-VIPVRRRGDSRGSLLSPRPISYLKGS AGGPLLCPAGHAVGIFRAAVCTRGVAKAV DFIPVEN-LETTMRSPVFTDNSSPPAVPQSFQVAHLHAPTGSGK-STKVPAAYAAQGYKVL VLNPSVAATLGF-GAYMSKAHGIDPNIRTGVRTITTGSPITYSTYGKFLA DGGCSGGAYDII ICDECHSTDATSIL-GIGTVLDQAETAGARLVVLATATPPGSVTVPHPNIE-EVALSTTGEIPF YGKAIPLEVIKGGRHLIFCHS-KKKCDELAAKLVALGINAVAYYRGLDVSVIPTSGD VVV VATDALMTGFTGDFDSVIDCN (SEQ ID NO:100); and has a length of from 550 amino acids (aa) to 560 aa (e.g., 550 aa, 551 aa, 552 aa, 553 aa, 554 aa, 555 aa, 556 aa, 557 aa, 558 aa, 559 aa, or 560 aa).

QASLLKVPYFVRVQGLLRICALARKMAGGHYVQ-MAIIKLGALTGTYVYNALTP LRDWAHNGLRDLAVA-VEPVVFSQMETKLITWGADTAACGDIINGLPVSARR-GREILLGP ADGMVSKGWRLLAPITAYAQQTRGLLGCIITSLT-GRDKNQVEGEVQIVSTAAQTFLATC INGVCWTVYHGAGTRTIAS-PKGPVIQMYTNVDQDLVGW-PAPQGARSLTPCTCGSSDLY LVTRHAD-VIPVRRRGDSRGSLLSPRPISYLKGS AGGPLLCPAGHAVGIFRAAVCTRGVAK AVDFIPVEN-LETTMRSPVFTDNSSPPAVPQSFQVAHLHAPTGSGK-STKVPAAYAAQGYK VLVLNPSVAATLGF-GAYMSKAHGIDPNIRTGVRTITTGSPITYSTYGKFLA DGGCSGGAY DIIICDECHSTDATSIL-GIGTVLDQAETAGARLVVLATATPPGSVTVPHPNIE-EVALSTTGE IPFYGKAIPLEVIKGGRHLIFCHS-KKKCDELAAKLVALGINAVAYYRGLDVSVIPTSGDV VVVATDALMTGFTGDFDSVIDCN (SEQ ID NO:100) is referred to in FIG. 10A-10B as "TP553."

In some cases, the HCV T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: QASLLKVPYFVRVQGLLRICALARK-MAGGHYVQMAIIKLGALTGTYVYNALTPLRDW AHNGLRDLAVAVEPVVFSQMETKLITWGADTAACG-DIINGLPVSARRGREILLGPADG MVSKGWRLLAPI-TAYAQQTRGLLGCIITSLTGRDKNQVEGEVQI-VSTAAQTFLATCING VCWTVYHGAGTRTIAS-PKGPVIQMYTNVDQDLVGW-PAPQGARSLTPCTCGSSDLYLVT RHAD-VIPVRRRGDSRGSLLSPRPISYLKGS AGGPLLCPAGHAVGIFRAAVCTRGVAKAV DFIPVEN-LETTMRSPVFTDNSSPPAVPQSFQVAHLHAPTGSGK-STKVPAAYAAQGYKVL VLNPSVAATLGF-GAYMSKAHGIDPNIRTGVRTITTGSPITYSTYGKFLA DGGCSGGAYDII ICDECHSTDATSIL-GIGTVLDQAETAGARLVVLATATPPGSVTVPHPNIE-EVALSTTGEIPF YGKAIPLEVIKGGRHLIFCHS-KKKCDELAAKLVALGINAVAYYRGLDVSVIPTSGDV VV VATDALMTGFTGDFDSVIDCN (SEQ ID NO:100); and has a length of 553 amino acids. Such a polypeptide can include T-cell epitopes designated NS2-1, NS2-2, NS2-3, NS2-4, NS2-5, NS2-6, NS2-7, NS2-8, NS3-1, NS3-2, NS3-3, NS3-4, NS3-5, NS3-6, NS3-7, NS3-9, NS3-10, NS3-11, NS3-12, and NS3-13 in FIG. 9A-9B and FIG. 11A-11N. This polypeptide is also referred to as "TP553" (FIG. 12A-12D). In order to prevent self cleavage of the TP553 polypeptide (amino acids 917-1469) (FIG. 11E-11G) at the NS2-NS3 junction that is mediated by the catalytic domain of the NS2 protease (amino acids 917-1040), the histidine at position 966 (H966), a critical residue for NS2 protease activity, is mutated to alanine (H966A) (FIG. 11E). See, e.g., Grakoui, A. et al. A second hepatitis C virus-encoded proteinase. Proc. Natl Acad. Sci.

USA 90, 10583-10587 (1993); Hijikata, M. et al. Two distinct proteinase activities required for the processing of a putative nonstructural precursor protein of hepatitis C virus. J. Virol. 67, 4665-4675 (1993); and Lorenz. I C. Structure of the catalytic domain of the hepatitis C virus NS2-3 protease. Nature. August 17; 442(7104):831-5 (2006).

As another example, the HCV T-cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 778 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 450 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 778 aa) the following amino acid sequence:

```
                                       (SEQ ID NO: 101)
LHAPTGSGKSTKVPAAYAAQGYKVLVLNPSVAATLGFGAYMSKAHGIDPN

IRTGVRTITTGSPITYSTYGKFLADGGCSGGAYDIIICDECHSTDATSIL

GIGTVLDQAETAGARLVVLATATPPGSVTVPHPNIEEVALSTTGEIPFYG

KAIPLEVIKGGRHLIFCHSKKKCDELAAKLVALGINAVAYYRGLDVSVIP

TSGDVVVVATDALMTGFTGDFDSVIDCNTCVTQTVDFSLDPTFTIETTTL

PQDAVSRTQRRGRTGRGKPGIYRFVAPGERPSGMFDSSVLCECYDAGCAW

YELTPAETTVRLRAYMNTPGLPVCQDHLEFWEGVFTGLTHIDAHFLSQTK

QSGENLPYLVAYQATVCARAQAPPPSWDQMWKCLIRLKPTLHGPTPLLYR

LGAVQNEVTLTHPITKYIMTCMSADLEVVTSTWVLVGGVLAALAAYCLST

GCVVIVGRIVLSGKPAIIPDREVLYREFDEMEECSQHLPYIEQGMMLAEQ

FKQKALGLLQTASRQAEVIAPAVQTNWQKLEAFWAKHMWNFISGIQYLAG

LSTLPGNPAIASLMAFTAAVTSPLTTSQTLLFNILGGWVAAQLAAPGAAT

AFVGAGLAGAAIGSVGLGKVLVDILAGYGAGVAGALVAFKIMSGEVPSTE

DLVNLLPAILSPGALVVGVVCAAILRRHVGPGEGAVQWMNRLIAFASRGN

HVSPTHYVPESDAAARVTAILSSLTVTQLLRRLHQWISSECTTPCSGSWL

RDIWDWICEVLSDFKTWLKAKLMPQLPG.
```

LHAPTGSGK-STKVPAAYAAQGYKVLVLNPSVAATLGF-GAYMSKAHGIDPNIRT GVRTITTGSPITYSTYGK-FLADGGCSGGAYDIIICDECHSTDATSILGIGTVLDQ AETAGA RLVVLATATPPGSVTVPHPNIEEVALSTT-GEIPFYGKAIPLEVIKGGRHLIFCHSKKKCDE LAAK-LVALGINAVAYYRGLDVSVIPTSGDVVV-VATDALMTGFTGDFDSVIDCNTCVTQ TVDFSLDPTFTIETTTLPQDAVSRTQRRGRT-GRGKPGIYRFVAPGERPSGMFDSSVLCEC YDAG-CAWYELTPAETTVRL-RAYMNTPGLPVCQDHLEFWEGVFTGLTHIDAHFLS QTKQ SGENLPYLVAYQATVCAR-AQAPPPSWDQMWKCLIRLKPTLHGPTPLLYRL-GAVQNEVT LTHPITKYIMTCMSA-DLEVVTSTWVLVGGVLAALAAYCLSTGCVVIVGRIV

LSGKPAIIP DREVLYREFDEMEECSQHLPYIEQGMM-LAEQFKQKALGLLQTASRQAEVIAPAVQTNW QKLEAFWAKHMWNFISGIQYLAGLSTLPGNPAIASL-MAFTAAVTSPLTTSQTLLFNILGG WVAAQLAAP-GAATAFVGAGLAGAAIGSVGLGKVLVDI-LAGYGAGVAGALVAFKIMSG EVPSTEDLVNLLPAILSPGALVVGVVCAAILR-RHVGPGEGAVQWMNRLIAFASRGNHVS PTHYVPES-DAAARV-TAILSSLTVTQLLRRLHQWISSECTTPCSGSWLRDI WDWICEVLSD FKTWLKAKLMPQLPG (SEQ ID NO:101) is referred to in FIG. 10B as "TP778."

In some cases, the HCV T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 778 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 300 aa, from 300 aa to 350 aa, from 350 aa to 400 aa, from 400 aa to 450 aa, from 450 aa to 500 aa, from 500 aa to 550 aa, from 550 aa to 600 aa, from 600 aa to 650 aa, from 650 aa to 700 aa, from 700 aa to 750 aa, or from 750 aa to 778 aa) of the following amino acid sequence: LHAPTGSGK-STKVPAAYAAQGYKVLVLNPSVAATLGF-GAYMSKAHGIDPNIRTGVRTIT TGSPITYSTYGK-FLADGGCSGGAYDIIICDECHSTDATSILGIGTVLDQ AETAGARLVVLA TATPPGSVTVPHPNIEEVALSTT-GEIPFYGKAIPLEVIKGGRHLIFCHSKKKCDE-LAAKLV ALGINAVAYYRGLDVSVIPTSGDVVV-VATDALMTGFTGDFDSVIDCNTCVTQTVDFSLD PTFTIETTTLPQDAVSRTQRRGRT-GRGKPGIYRFVAPGERPSGMFDSSVLCECYDAGCA WYELTPAETTVRL-RAYMNTPGLPVCQDHLEFWEGVFTGLTHI-DAHFLSQTKQSGENLP YLVAYQATVCAR-AQAPPPSWDQMWKCLIRLKPTLHGPTPLLYRLGAVQ-NEVTLTHPIT KYIMTCMSADLEVVTSTWVLVGGVLAALAAYCL-STGCVVIVGRIVLSGKPAIIPDREVL YREFDE-MEECSQHLPYIEQGMMLAEQFKQKALGLLQTAS-RQAEVIAPAVQTNWQKLEA FWAKHMWNFISGIQYLAGLSTLPGNPAIASLMA-FTAAVTSPLTTSQTLLFNILGGWVAA QLAAP-GAATAFVGAGLAGAAIGSVGLGKVLVDI-LAGYGAGVAGALVAFKIMSGEVPST EDLVNLLPAILSPGALVVGVVCAAILR-RHVGPGEGAVQWMNRLIAFASRGNHVSPTHY VPES-DAAARV-TAILSSLTVTQLLRRLHQWISSECTTPCSGSWLRDIWD-WICEVLSDFKTW LKAKLMPQLPG (SEQ ID NO:101); and has a length of from 25 amino acids (aa) to 50 aa, from 50 aa to 100 aa, from 100 aa to 200 aa, from 200 aa to 300 aa, from 300 aa to 400 aa, from 400 aa to 500 aa, from 500 aa to 600 aa, from 600 aa to 700 aa, or from 700 aa to 778 aa. In some cases, the HCV T-cell epitope polypeptide comprises an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: LHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLV ALGINAVAYYRGLDVSVIPTSGDVVVVATDALMTGFTGDFDSVIDCNTCVTQTVDFSLDPTFTIETTTLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLP YLVAYQATVCARAQAPPPSWDQMWKCLIRLKPTLHGPTPLLYRLGAVQNEVTLTHPITKYIMTCMSADLEVVTSTWVLVGGVLAALAAYCLSTGCVVIVGRIVLSGKPAIIPDREVL YREFDEMEECSQHLPYIEQGMMLAEQFKQKALGLLQTASRQAEVIAPAVQTNWQKLEAFWAKHMWNFISGIQYLAGLSTLPGNPAIASLMAFTAAVTSPLTTSQTLLFNILGGWVAA QLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGNHVSPTHY VPESDAAARVTAILSSLTVTQLLRRLHQWISSECTTPCSGSWLRDIWDWICEVLSDFKTW LKAKLMPQLPG (SEQ ID NO:101); and has a length of 778 amino acids. Such a polypeptide can include T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS2-14, NS4a-1, NS4b-1, NS4b-2, NS4b-3, NS4b-4, NS4b-5, NS4b-6, NS4b-7, NS4b-8, NS4b-9, and NS4b-10 in FIG. 9B and FIG. 11A-11N.

As another example, the HCV T-cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to a contiguous stretch of from 25 amino acids (aa) to 1985 aa (e.g., from 25 aa to 50 aa, from 50 aa to 75 aa, from 75 aa to 100 aa, from 100 aa to 150 aa, from 150 aa to 200 aa, from 200 aa to 250 aa, from 250 aa to 500 aa, from 500 aa to 750 aa, from 750 aa to 1000 aa, from 1000 aa to 1500 aa, or from 1500 aa to 1985 aa) of the following amino acid sequence:

(SEQ ID NO: 102)
APITAYAQQTRGLLGCIITSLTGRDKNQVEGEVQIVSTAAQTFLATCING

VCWTVYHGAGTRTIASPKGPVIQMYTNVDQDLVGWPAPQGARSLTPCTCG

SSDLYLVTRHADVIPVRRRGDSRGSLLSPRPISYLKGS<u>A</u>GGPLLCPAGHA

VGIFRAAVCTRGVAKAVDFIPVENLETTMRSPVFTDNSSPPAVPQSFQVA

HLHAPTGSGKSTKVPAAYAAQGYKVLVLNPSVAATLGFGAYMSKAHGIDP

NIRTGVRTITTGSPITYSTYGKFLADGGCSGGAYDIIICDECHSTDATSI

LGIGTVLDQAETAGARLVVLATATPPGSVTVPHPNIEEVALSTTGEIPFY

-continued
GKAIPLEVIKGGRHLIFCHSKKKCDELAAKLVALGINAVAYYRGLDVSVI

PTSGDVVVVATDALMTGFTGDFDSVIDCNTCVTQTVDFSLDPTFTIETTT

LPQDAVSRTQRRGRTGRGKPGIYRFVAPGERPSGMFDSSVLCECYDAGCA

WYELTPAETTVRLRAYMNTPGLPVCQDHLEFWEGVFTGLTHIDAHFLSQT

KQSGENLPYLVAYQATVCARAQAPPPSWDQMWKCLIRLKPTLHGPTPLLY

RLGAVQNEVTLTHPITKYIMTCMSADLEVVTSTWVLVGGVLAALAAYCLS

TGCVVIVGRIVLSGKPAIIPDREVLYREFDEMEECSQHLPYIEQGMMLAE

QFKQKALGLLQTASRQAEVIAPAVQTNWQKLEAFWAKHMWNFISGIQYLA

GLSTLPGNPAIASLMAFTAAVTSPLTTSQTLLFNILGGWVAAQLAAPGAA

TAFVGAGLAGAAIGSVGLGKVLVDILAGYGAGVAGALVAFKIMSGEVPST

EDLVNLLPAILSPGALVVGVVCAAILRRHVGPGEGAVQWMNRLIAFASRG

NHVSPTHYVPESDAAARVTAILSSLTVTQLLRRLHQWISSECTTPCSGSW

LRDIWDWICEVLSDFKTWLKAKLMPQLPGIPFVSCQRGYRGVWRGDGIMH

TRCHCGAEITGHVKNGTMRIVGPRTCRNMWSGTFPINAYTTGPCTPLPAP

NYTFALWRVSAEEYVEIRQVGDFHYVTGMTTDNLKCPCQVPSPEFFTELD

GVRLHRFAPPCKPLLREEVSFRVGLHEYPVGSQLPCEPEPDVAVLTSMLT

DPSHITAEAAGRRLARGSPPSVASSSASQLSAPSLKATCTANHDSPDAEL

IEANLLWRQEMGGNITRVESENKVVILDSFDPLVAEEDEREISVPAEILR

KSRRFAPALPIWARPDYNPPLLETWKKPDYEPPVVHGCPLPPPQSPPVPP

PRKKRTVVLTESTVSTALAELATKSFGSSSTSGITGDNTTTSSEPAPSGC

PPDSDAESYSSMPPLEGEPGDPDLSDGSWSTVSSEADTEDVVCCSMSYSW

TGALVTPCAAEEQKLPINALSNSLLRHHNLVYSTTSRSACQRQKKVTFDR

LQVLDSHYQDVLKEVKAAASKVKANLLSVEEACSLTPPHSAKSKFGYGAK

DVRCHARKAVNHINSVWKDLLEDSVTPIDTTIMAKNEVFCVQPEKGGRKP

ARLIVFPDLGVRVCEKMALYDVVSKLPLAVMGSSYGFQYSPGQRVEFLVQ

AWKSKKTPMGFSYDTRCFDSTVTESDIRTEEAIYQCCDLDPQARVAIKSL

TERLYVGGPLTNSRGENCGYRRCRASGVLTTSCGNTLTCYIKARAACRAA

GLQDCTMLVCG<u>NN</u>LVVICESAGVQEDAASLRAFTEAMTRYSAPPGDPPQP

EYDLELITSCSSNVSVAHDGAGKRVYYLTRDPTTPLARAAWETARHTPVN

SWLGNIIMFAPTLWARMILMTHFFSVLIARDQLEQALDCEIYGACYSIEP

LDLPPIIQRLHGLSAFSLHSYSPGEINRVAACLRKLGVPPLRAWRHRARS

VRARLLSRGGRAAICGKYLFNWAVRTKLKLTPIAAAGQLDLSGWFTAGYS

GGDIYHSVSHARPRWFWFCLLLLAAGVGIYLLPNR.

In some cases, the HCV T-cell epitope polypeptide can comprise an amino acid sequence having at least about 20%, at least about 25%, at least about 30%, at least about 35%, at least about 40%, at least about 45%, at least about 50%, at least about 60%, at least about 70%, at least about 75%, at least about 80%, at least about 85%, at least about 90%, at least about 95%, at least about 98%, at least about 99%, or 100%, amino acid sequence identity to the following amino acid sequence: APITAYAQQTRGLLGCIITSLTGRDKNQVEGEVQIVSTAAQTFLATCINGVCWTVYHGA GTRTIASPKGPVIQMYTNVDQDLVGWPAPQGARSLTPCTCG SSDLYLVTRHADVIPVRR RGDSRGSLLSPRPI- SYLKGS
AGGPLLCPAGHAVGIFRAAVCTRGVAKAVDFIPVENL
ETT MRSPVFTDNSSPPAVPQSFQVAHLHAPTGSGK-
STKVPAAYAAQGYKVLVLNPSVAATL
GFGAYMSKAHGIDPNIRTGVRTITTGSPITYSTYGK-
FLADGGCSGGAYDIIICDECHSTDA TSIL-
GIGTVLDQAETAGARLVVLATATPPGSVTVPHPNIE-
EVALSTTGEIPFYGKAIPLEVI
KGGRHLIFCHSKKKCDELAAKLVALGINAVAYYR-
GLDVSVIPTSGDVVVVATDALMTG
FTGDFDSVIDCNTCVTQTVDFSLDPTFTIETTTLPQ-
DAVSRTQRRGRTGRGKPGIYRFVAP
GERPSGMFDSSVLCECYDAGCAWYELTPAETTVRL-
RAYMNTPGLPVCQDHLEFWEGV FTGLTHI-
DAHFLSQTKQSGENLPYLVAYQATVCAR-
AQAPPPSWDQMWKCLIRLKPTLH
GPTPLLYRLGAVQNEVTLTHPITKYIMTCMSA-
DLEVVTSTWVLVGGVLAALAAYCLST GCV-
VIVGRIVLSGKPAIIPDREVLYREFDE-
MEECSQHLPYIEQGMMLAEQFKQKALGLLQ
TASRQAEVIAPAVQTNWQKLEAFWAKHMWNFIS-
GIQYLAGLSTLPGNPAIASLMAFTA AVT-
SPLTTSQTLLFNILGGWVAAQLAAPGAATAFVGAGL-
AGAAIGSVGLGKVLVDILAG
YGAGVAGALVAFKIMSGEVPSTEDLVNLLPAILSP-
GALVVGVVCAAILRRHVGPGEGAV QWMNRLIAFAS-
RGNHVSPTHYVPESDAAARV-
TAILSSLTVTQLLRRLHQWISSECTTPCS
GSWLRDIWDWICEVLSDFKTWLKAKLMPQLP-
GIPFVSCQRGYRGVWRGDGIMHTRCH
CGAEITGHVKNGTMRIVGPRTCRNMWSGTFPINAY-
TTGPCTPLPAPNYTFALWRVSAEE
YVEIRQVGDFHYVTGMTTDNLKCPCQVPSPEF-
FTELDGVRLHRFAPPCKPLLREEVSFR VGLHEY-
PVGSQLPCEPEPDVAVLTSMLTDPSHITAEAAGRR-
LARGSPPSVASSSASQLSA
PSLKATCTANHDSPDAELIEANLLWRQEMGGNITR-
VESENKVVILDSFDPLVAEEDEREI SVPAEILRKSRR-
FAPALPIWARPDYNPPL-
LETWKKPDYEPPVVHGCPLPPPQSPPVPPPRK
KRTVVLTESTVSTALAELATKSFGSSST-
SGITGDNTTTSSEPAPSGCPPDSDAESYSSMPP
LEGEPGDPDLSDGSWSTVSSEADTEDVVCCSMSYS-
WTGALVTPCAAEEQKLPINALSNS
LLRHHNLVYSTTSRSACQRQKKVTFDRLQVLDSHY-
QDVLKEVKAAASKVKANLLSVEE ACSLTPPHSAK-
SKFGYGAKDVRCHARKAVNHINSVWKDLLEDSVT-
PIDTTIMAKNEVFC
VQPEKGGRKPARLIVFPDLGVRVCEKMALYDVVSK-
LPLAVMGSSYGFQYSPGQRVEFL VQAWK-
SKKTPMGFSYDTRCFDSTVTESDIRTEE-
AIYQCCDLDPQARVAIKSLTERLYVG
GPLTNSRGENCGYRRCRASGVLTTSCGNTLTCYIK-
ARAACRAAGLQDCTMLVCGNNLV VIC-
ESAGVQEDAASLRAFTEAMTRYSAPPGDPPQPEY-
DLELITSCSSNVSVAHDGAGKR
VYYLTRDPTTPLARAAWETARHTPVN-
SWLGNIIMFAPTLWARMILMTHFFSVLIARDQL
EQALDCEIYGACYSIEPLDLPPIIQRLHGLSAFSLH-
SYSPGEINRVAACLRKLGVPPLRAW
RHRARSVRARLLSRGGRAAICGKYLFNWAV-
RTKLKLTPIAAAGQLDLSGWFTAGYSGG
DIYHSVSHARPRWFWFCLLLLAAGVGIYLLPNR (SEQ ID NO:102); and has a length of 1985 amino acids. Such a polypeptide can include T-cell epitopes designated NS3-1, NS3-2, NS3-3, NS3-4, NS3-5, NS3-6, NS3-7, NS3-8, NS3-9, NS3-10, NS3-11, NS3-12, NS3-13, NS3-14, NS4a-1, NS4b-1, NS4b-2, NS4b-3, NS4b-4, NS4b-5, NS4b-6, NS4b-7, NS4b-8, NS4b-9, NS4b-10, NS5a-1, NS5a-2, NS5b-1, NS5b-2 in FIG. 9A-9B and FIG. 11A-11N.

Additional T-Cell Epitopes

As discussed above, an immunogenic composition of the present disclosure includes an HCV T-cell epitope polypeptide that comprises one or more T-cell epitopes (e.g., one or more T cell epitopes present in an HCV polypeptide other than an HCV E1 polypeptide or an HCV E2 polypeptide). The one or more T-cell epitopes can include one or more T-cell epitopes present in: a) an HCV NS3 polypeptide; b) an HCV NS2 polypeptide; c) an HCV NS4A polypeptide; d) an HCV NS4B polypeptide; e) an HCV NS5A polypeptide; f) an HCV NS5B polypeptide; g) an HCV core polypeptide; or h) an HCV p7 polypeptide. In some cases, the one or more T-cell epitopes are T-cell epitopes present in an HCV NS3 polypeptide. In some cases, the HCV T-cell epitope polypeptide further comprises one or more T cell epitopes present in: a) cholera toxin or toxoid; and/or b) tetanus toxin or toxoid; and/or c) diphtheria toxin or toxoid; and/or d) a meningococcal outer membrane protein.

Thus, in some cases, an immunogenic composition of the present disclosure includes: a) an HCV T-cell epitope polypeptide that comprises one or more T-cell epitopes, where the one or more T-cell epitopes are T-cell epitopes present in: i) one or more of an HCV NS3 polypeptide, an HCV NS2 polypeptide, an HCV NS4A polypeptide, an HCV NS4B polypeptide, an HCV NS5A polypeptide, an HCV NS5B polypeptide, an HCV core polypeptide, and an HCV p7 polypeptide; and ii) one or more of cholera toxin or toxoid, tetanus toxin or toxoid, diphtheria toxin or toxoid, and a meningococcal outer membrane protein.

A T helper tetanus toxin epitope or other bacterial T-cell epitope could be fused (e.g., by recombinant expression) or chemically conjugated to the HCV T-cell epitope polypeptide, or can be unconjugated (e.g., provided as a separate polypeptide), to further enhance both T and B cell responses to both the T-cell epitopes present in the HCV T-cell epitope polypeptide. Alternatively, the whole or part of the detoxified toxin ("toxoid") can be used, wherein specific amino acids of the toxins are mutated to render the toxins inactive, thereby generating toxoids. Methods of generating toxoids are well known in the art. Examples of bacterial epitopes include the use of diphtheria toxoid, meningococcal outer membrane protein, or mutant diphtheria protein CRM197 (see, e.g.: http://www(dot)medscape(dot)com/viewarticle/431127).

In some cases, a suitable tetanus toxoid polypeptide comprises the amino acid sequence QYIKANSKFIGIFE (SEQ ID NO:103). In some cases, a suitable tetanus toxoid polypeptide comprises the amino acid sequence QYIKANSKFIGITE (SEQ ID NO:104).

In some cases, a HCV T-cell epitope polypeptide can comprise cholera toxin (or toxoid) epitope. In some cases, a suitable HCV T-cell epitope polypeptide comprising a cholera toxoid epitope comprises a fragment of cholera toxin-B subunit (CT-B), e.g., a fragment of from 5 amino acids to 25 amino acids, or from 25 amino acids to 50 amino acids, of the following amino acid sequence: MIKLKFGVFF TVLLSSAYAH GTPQNITDLC AEYHNTQIHT LNDKIFSYTE SLAGKREMAI ITFKNGATFQ VEVPGSQHID SQKKAIERMK DTLRIAYLTE AKVEKLCVWN NKTPHAIAAI SMAN (SEQ ID NO:105).

In some cases, a HCV T-cell epitope polypeptide can comprise a tetanus toxin (or toxoid) T-cell epitope. In some cases, a suitable HCV T-cell epitope polypeptide comprising a tetanus toxin T-cell epitope comprises the amino acid sequence: ILMQYIKANSKFIGI (SEQ ID NO:106); and has a length of from 15 amino acids to 20 amino acids. In some cases, a suitable HCV T-cell epitope polypeptide comprising a tetanus toxin T-cell epitope comprises the amino acid sequence: VNNESSE (SEQ ID NO:107). In some cases, a suitable HCV T-cell epitope polypeptide comprising a tetanus toxin T-cell epitope comprises the amino acid sequence: PGINGKAIHLVNNESSE (SEQ ID NO:108). In some cases, a suitable HCV T-cell epitope polypeptide comprising a tetanus toxin T-cell epitope comprises the amino acid sequence: PNRDIL (SEQ ID NO:109). In some cases, a suitable HCV T-cell epitope polypeptide comprising a tetanus toxin T-cell epitope comprises the amino acid sequence: FIGITEL (SEQ ID NO:110). In some cases, a suitable tetanus toxin T-cell epitope comprises the amino acid sequence: SYFPSV (SEQ ID NO:111). In some cases, a suitable HCV T-cell epitope polypeptide comprising a tetanus toxin T-cell epitope comprises the amino acid sequence: NSVDDALINSTKIYSYFPSV (SEQ ID NO:112). In some cases, a suitable HCV T-cell epitope polypeptide comprising a tetanus toxin T-cell epitope comprises the amino acid sequence: IDKISDVSTIVPYIGPALNI (SEQ ID NO:113).

In some cases, a HCV T-cell epitope polypeptide can comprise a diphtheria toxin T-cell epitope In some cases, a suitable HCV T-cell epitope polypeptide comprising a diphtheria toxin T-cell epitope comprises the amino acid sequence: QSIALSSLMVAQAIP (SEQ ID NO:114); and has a length of from 15 amino acids to 20 amino acids. In some cases, a suitable HCV T-cell epitope polypeptide comprising a diphtheria toxin T-cell epitope comprises the amino acid sequence: PVFAGANYAAWAVNVAQVI (SEQ ID NO:115). In some cases, a suitable HCV T-cell epitope polypeptide comprising a diphtheria toxin T-cell epitope comprises the amino acid sequence: VHHNTEEIVAQSIALSSLMV (SEQ ID NO:116). In some cases, a suitable HCV T-cell epitope polypeptide comprising a diphtheria toxin T-cell epitope comprises the amino acid sequence: QSIALSSLMVAQAIPLVGEL (SEQ ID NO:117). In some cases, a suitable HCV T-cell epitope polypeptide comprising a diphtheria toxin T-cell epitope comprises the amino acid sequence: VDIGFAAYNFVESIINLFQV (SEQ ID NO:118). In some cases, a suitable HCV T-cell epitope polypeptide comprising a diphtheria toxin T-cell epitope comprises the amino acid sequence: QGESGHDIKITAENTPLPIA (SEQ ID NO:119). In some cases, a suitable HCV T-cell epitope polypeptide comprising a diphtheria toxin T-cell epitope comprises the amino acid sequence: GVLLPTIPGKLDVNKSKTHI (SEQ ID NO:120). In some cases, a suitable HCV T-cell epitope polypeptide comprising a diphtheria toxin T-cell epitope comprises the amino acid sequence of CRM197 (see, e.g., Giannini et al. (1984) *Nucl. Acids. Res.* 12:4063).

The amino acid sequence of CRM197 is as follows:

```
                                       (SEQ ID NO: 121)
laddvvdssksfvmenfssyhgtkpgyvdsiqkgiqkpksgtqgnydddw

kefystdnkydaagysvdnenplsgkaggvvkvtypgltkvlalkvdnae

tikkelglslteplmeqvgteefikrfgdgasrvvlslpfaegsssveyi

nnweqakalsveleinfetrgkrgqdamyeymaqacagnrvrrsvgssls

cinldwdvirdktktkieslkehgpiknkmsespnktvseekakqyleef

hqtalehpelselktvtgtnpvfaganyaawavnvaqvidsetadnlekt
```

-continued

```
taalsilpgigsvmgiadgavhhnteeivaqsialsslmvaqaiplvgel

vdigfaaynfvesiinlfqvvhnsynrpayspghktqpflhdgyavswnt

vedsiirtgfqgesghdikitaentplpiagvllptipgkldvnkskthi

svngrkirmrcraidgdvtfcrpkspvyvgngvhanlhvafhrsssekih

sneissdsigvlgyqktvdhtkvnsklslffeiks.
```

In some cases, an HCV T-cell epitope polypeptide can comprise a tetanus toxin T-cell epitope and a diphtheria toxin T-cell epitope. In some of these cases, the HCV T-cell epitope polypeptide can comprise the amino acid sequence: IMQYIKANSKFIGIQSIALSSLMVAQ (SEQ ID NO:122); and can have a length of from 26 amino acids to 30 amino acids.

Mixtures of HCV T-cell epitope polypeptides

In some cases, an immunogenic composition of the present disclosure comprises two or more different HCV T-cell epitope polypeptides comprising a T-cell epitope present in an HCV protein other than E1 and E2 (e.g., a mixture of two or more different HCV T-cell epitope polypeptides comprising a T-cell epitope present in an HCV protein other than E1 and E2).

For example, in some cases, an immunogenic composition of the present disclosure comprises: a) two or more different HCV T-cell epitope polypeptides comprising a T-cell epitope present in an HCV protein other than E1 and E2; and b) a pharmaceutically acceptable excipient. In some cases, an immunogenic composition of the present disclosure comprises: a) two or more different HCV T-cell epitope polypeptides comprising a T-cell epitope present in an HCV protein other than E1 and E2; and b) a pharmaceutically acceptable excipient.

For example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP50, and having a length of from 50 amino acids to 55 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP52, and having a length of from 52 amino acids to 60 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP70, and having a length of from 70 amino acids to 75 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP100, and having a length of from 100 amino acids to 110 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP171, and having a length of from 171 amino acids to 180 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP228, and having a length of from 228 amino acids to 235 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP553, and having a length of from 553 amino acids to 565 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP29, and having a length of from 29 amino acids to 35 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP778, and having a length of from 778 amino acids to 785 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP50, and having a length of from 50 amino acids to 55 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP52 and having a length of from 52 amino acids to 60 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP50, and having a length of from 50 amino acids to 55 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP70 and having a length of from 70 amino acids to 80 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP50, and having a length of from 50 amino acids to 55 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP100 and having a length of from 100 amino acids to 110 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP50, and having a length of from 50 amino acids to 55 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP171 and having a length of from 171 amino acids to 180 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP50, and having a length of from 50 amino acids to 55 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP228 and having a length of from 228 amino acids to 240 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP50, and having a length of from 50 amino acids to 55 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP553 and having a length of from 553 amino acids to 570 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP50, and having a length of from 50 amino acids to 55 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP778 and having a length of from 778 amino acids to 790 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP52, and having a length of from 52 amino acids to 60 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP70 and having a length of from 70 amino acids to 80 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP52, and having a length of from 52 amino acids to 60 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP100 and having a length of from 100 amino acids to 110 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP52, and having a length of from 52 amino acids to 60 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP171 and having a length of from 171 amino acids to 180 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP52, and having a length of from 52 amino acids to 60 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP228 and having a length of from 228 amino acids to 240 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP52, and having a length of from 52 amino acids to 60 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP553 and having a length of from 553 amino acids to 570 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP52, and having a length of from 52 amino acids to 60 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP778 and having a length of from 778 amino acids to 790 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP70, and having a length of from 70 amino acids to 80 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP100 and having a length of from 100 amino acids to 110 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP70, and having a length of from 70 amino acids to 80 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP171 and having a length of from 171 amino acids to 190 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP70, and having a length of from 70 amino acids to 80 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP228 and having a length of from 228 amino acids to 240 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP70, and having a length of from 70 amino acids to 80 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP553 and having a length of from 553 amino acids to 570 amino acids.

As another example, the two or more different HCV T-cell epitope polypeptides can include: i) a first HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP70, and having a length of from 70 amino acids to 80 amino acids; and ii) a second HCV T-cell epitope polypeptide comprising an amino acid sequence having at least 20%, at least 30%, at least 40%, at least 50%, at least 60%, at least 70%, at least 80%, at least 90%, at least 95%, at least 98%, or 100%, amino acid sequence identity to TP778 and having a length of from 778 amino acids to 790 amino acids.

Pharmaceutically Acceptable Excipients

As noted above, an immunogenic composition of the present disclosure can comprise: a) an HCV T-cell epitope polypeptide; and b) a pharmaceutically acceptable excipient. A wide variety of pharmaceutically acceptable excipients is known in the art and need not be discussed in detail herein. Pharmaceutically acceptable excipients have been amply described in a variety of publications, including, for example, A. Gennaro (2000) "Remington: The Science and Practice of Pharmacy", 20th edition, Lippincott, Williams, & Wilkins; Pharmaceutical Dosage Forms and Drug Delivery Systems (1999) H. C. Ansel et al., eds 7th ed., Lippincott, Williams, & Wilkins; and Handbook of Pharmaceutical Excipients (2000) A. H. Kibbe et al., eds., 3rd ed. Amer. Pharmaceutical Assoc.

In some embodiments, an HCV T-cell epitope polypeptide is formulated in an aqueous buffer. Suitable aqueous buffers include, but are not limited to, acetate, succinate, citrate, and phosphate buffers varying in strengths from about 5 mM to about 100 mM. In some embodiments, the aqueous buffer includes reagents that provide for an isotonic solution. Such reagents include, but are not limited to, sodium chloride; and sugars e.g., mannitol, dextrose, sucrose, and the like. In some embodiments, the aqueous buffer further includes a non-ionic surfactant such as polysorbate 20 (TWEEN®20) or polysorbate 80 (TWEEN®80). For example, a formulation of an HCV T-cell epitope polypeptide in an aqueous buffer can include, e.g., from about 0.01% to about 0.05% polysorbate-20 (TWEEN®20) non-ionic detergent. Optionally the formulations may further include a preservative. Suitable preservatives include, but are not limited to, a benzyl alcohol, phenol, chlorobutanol, benzalkonium chloride, and the like. In many cases, the formulation is stored at about 4° C. Formulations may also be lyophilized, in which case they generally include cryoprotectants such as sucrose, trehalose, lactose, maltose, mannitol, and the like. Lyophilized formulations can be stored over extended periods of time, even at ambient temperatures. In some cases, the aqueous buffer further includes a non-ionic surfactant. In some cases, the aqueous buffer includes the non-ionic surfactant Triton™X-100, e.g., 0.1% Triton™X-100.

An HCV T-cell epitope polypeptide can be formulated into a preparation for injection by dissolving, suspending or emulsifying the polypeptide in an aqueous or nonaqueous solvent, such as vegetable or other similar oils, synthetic aliphatic acid glycerides, esters of higher aliphatic acids or propylene glycol; and if desired, with conventional additives such as solubilizers, isotonic agents, suspending agents, emulsifying agents, stabilizers and preservatives.

An immunogenic composition of the present disclosure can include, e.g., pharmaceutical grades of mannitol, lactose, starch, magnesium stearate, sodium saccharin, talcum, cellulose, glucose, sucrose, magnesium, carbonate, and the like. The compositions may contain pharmaceutically acceptable auxiliary substances as required to approximate physiological conditions such as pH adjusting and buffering agents, toxicity adjusting agents and the like, for example, sodium acetate, sodium chloride, potassium chloride, calcium chloride, sodium lactate and the like.

The concentration of an HCV T-cell epitope polypeptide in a formulation can vary widely (e.g., from less than about 0.1% to at least about 2%, to as much as 20% to 50% or more by weight) and can be selected primarily based on fluid volumes, viscosities, and patient-based factors in accordance with the particular mode of administration selected and the patient's needs.

An immunogenic composition of the present disclosure can be provided in the form of a solution, suspension, tablet, pill, capsule, powder, gel, cream, lotion, ointment, aerosol or the like. It is recognized that oral administration can require protection of the compositions from digestion. This is typically accomplished either by association of the composition with an agent that renders it resistant to acidic and enzymatic hydrolysis or by packaging the composition in an appropriately resistant carrier. Means of protecting from digestion are well known in the art.

An immunogenic composition of the present disclosure can also be provided so as to enhance serum half-life of the polypeptides (an HCV T-cell epitope polypeptide), following administration. For example, where an HCV T-cell epitope polypeptide is formulated for injection, the polypeptide may be provided in a liposome formulation, prepared as a colloid, or other conventional techniques for extending serum half-life. A variety of methods are available for preparing liposomes, as described in, e.g., Szoka et al., Ann Rev. Biophys. Bioeng. 9:467 (1980), U.S. Pat. Nos. 4,235,871, 4,501,728 and 4,837,028. The preparations may also be provided in controlled release or slow-release forms.

Adjuvant

An immunogenic composition of the present disclosure can include an adjuvant. Examples of known suitable adjuvants that can be used in humans include, but are not necessarily limited to, alum (e.g., aluminum phosphate; aluminum hydroxide), MF59™ (4.3% w/v squalene, 0.5% w/v Tween 80™ (polysorbate 80), 0.5% w/v Sorbitan trioleate (Span® 85)), CpG-containing nucleic acid (where the cytosine is unmethylated), QS21, monophosphoryl lipid A (MPL), 3-Q-desacyl-4'-monophosphoryl lipid A (3DMPL), extracts from Aquilla, immune-stimulating complexes (ISCOMS; complexes of cholesterol, phospholipids, and *Quillaia* saponins), LT/CT mutants, poly(D,L-lactide-co-glycolide) (PLG) microparticles, saponin vaccine adjuvant (Quil A®), interleukins, and the like. For experimental animals, one can use Freund's incomplete adjuvant, or Freund's complete adjuvant. Also suitable for use are N-acetyl-muramyl-L-threonyl-D-isoglutamine (thr-MDP), N-acetyl-nor-muramyl-L-alanyl-D-isoglutamine (CGP 11637, referred to as nor-MDP), N-acetylmuramyl-L-alanyl-D-isoglutaminyl-L-alanine-2-(1'-2'-dipalmitoyl-sn-glycero-3-hydroxyphosphoryloxy)-ethylamine (CGP 19835A, referred to as MTP-PE), and RIBI™, which contains three components extracted from bacteria: monophosphoryl lipid A, trehalose dimycolate and cell wall skeleton (MPL+TDM+CWS) in a 2% squalene Tween 80™ (polysorbate 80) emulsion. The effectiveness of an adjuvant may be determined by one or more of measuring the amount of antibodies directed against the immunogenic antigen or antigenic epitope thereof, measuring a cytotoxic T lymphocyte response to the antigen, and measuring a helper T cell response to the antigen.

Further exemplary adjuvants to enhance effectiveness of the composition include, but are not limited to: (1) oil-in-water emulsion formulations (with or without other specific immunostimulating agents such as muramyl peptides (see below) or bacterial cell wall components), such as for example (a) MF59™ (see, e.g., WO 90/14837), containing 5% Squalene, 0.5% Tween 80™ (polysorbate 80), and 0.5% Sorbitan trioleate (Span® 85) (optionally containing MTP-PE) formulated into submicron particles using a microfluidizer, (b) SAF, containing 10% Squalane, 0.4% Tween 80™ (polysorbate 80), 5% pluronic-blocked polymer L121, and thr-MDP either microfluidized into a submicron emulsion or vortexed to generate a larger particle size emulsion, and (c) RIBI™ adjuvant system (RAS), (Ribi Immunochem, Hamilton, Mont.) containing 2% Squalene, 0.2% Tween 80™ (polysorbate 80), and one or more bacterial cell wall components such as monophosphorylipid A (MPL), trehalose dimycolate (TDM), and cell wall skeleton (CWS), e.g., MPL+CWS (Detox™); (2) saponin adjuvants, such as QS21 or Stimulon™ (Cambridge Bioscience, Worcester, Mass.; a purified extract of *Quillaja saponaria*) may be used or particles generated therefrom such as ISCOMs (immunostimulating complexes), which ISCOMS may be devoid of additional detergent e.g. WO 00/07621; (3) Complete Freund's Adjuvant (CFA) and Incomplete Freund's Adjuvant (IFA); (4) cytokines, such as interleukins (e.g. IL-1, IL-2, IL-4, IL-5, IL-6, IL-7, IL-12 (WO99/44636), etc.), interferons (e.g. gamma interferon), macrophage colony stimulating factor (M-CSF), tumor necrosis factor (TNF), etc.; (5) monophosphoryl lipid A (MPL) or 3-O-deacylated MPL (3dMPL) e.g. GB-2220221, EP-A-0689454, optionally in the substantial absence of alum when used with pneumococcal saccharides e.g. WO 00/56358; (6) combinations of 3dMPL with, for example, QS21 and/or oil-in-water emulsions (see, e.g. EP-A-0835318, EP-A-0735898, EP-A-0761231); (7) oligonucleotides comprising a CpG motif containing at least one CG dinucleotide, where the cytosine is unmethylated (see, e.g., WO 96/02555, WO 98/16247, WO 98/18810, WO 98/40100, WO 98/55495, WO 98/37919 and WO 98/52581); (8) a polyoxyethylene ether or a polyoxyethylene ester (see, e.g. WO 99/52549); (9) a polyoxyethylene sorbitan ester surfactant in combination with an octoxynol (WO 01/21207) or a polyoxyethylene alkyl ether or ester surfactant in combination with at least one additional non-ionic surfactant such as an octoxynol (WO 01/21152); (10) a saponin and an immunostimulatory oligonucleotide (e.g. a CpG oligonucleotide) (WO 00/62800); (11) an immunostimulant and a particle of metal salt (see, e.g. WO 00/23105); (12) a saponin and an oil-in-water emulsion (see e.g. WO 99/11241); (13) a saponin (e.g. QS21)+3dMPL+IM2 (optionally including a sterol) (see, e.g. WO 98/57659); (14) other substances that act as immunostimulating agents to enhance the efficacy of the composition. Muramyl peptides include N-acetyl-muramyl-L-threonyl-D-isoglutamine (thr-MDP), N-25 acetyl-normuramyl-L-alanyl-D-isoglutamine (nor-MDP), N-acetylmuramyl-L-alanyl-D-isoglutarninyl-L-alanine-2-(1'-2'-dipalmitoyl-sn-glycero-3-hydroxyphosphoryloxy)-ethylamine MTP-PE), etc. Also suitable for use is Matrix-M™; Matrix-M™ is an adjuvant that comprises 40 nm nanoparticles comprising *Quillaja* saponins, cholesterol, and phospholipid. Adjuvants suitable for administration to a human are of particular interest. In some cases, the adjuvant is one that enhances a $CD4^+$ T helper response to the immunogen. Also suitable for use is a poly inosine:cytosine (poly I:C) nucleic acid. Poly I:C is a synthetic double-stranded RNA Also suitable for use is a cyclic dinucleotide activator of the STING pathway. Examples of suitable cyclic dinucleotide adjuvants include, but are not limited to: 1) bis-(3',5')-cyclic dimeric adenosine monophosphate (c-di-AMP); 2) bis-(3',5')-cyclic dimeric guanosine monophosphate (c-di-GMP); and bis-(3',5')-cyclic dimeric inosine monosphosphate (c-di-IMP).

In some instances, the adjuvant is MF59, with or without a CpG-containing oligonucleotide. In other instances, the adjuvant is alum, with or without a CpG-containing oligonucleotide. In other instances, the adjuvant is poly(D,L-lactide-co-glycolide), with or without a CpG-containing oligonucleotide. In other instances, the adjuvant is MPL, with or without a CpG-containing oligonucleotide. In some cases, the adjuvant is Matrix-M™, with or without a CpG-containing oligonucleotide. In some cases, the adjuvant is keyhole limpet hemocyanin. In some cases, the adjuvant is alum. In some cases, the adjuvant is aluminum phosphate. In some cases, the adjuvant is aluminum hydroxide. In some cases, the adjuvant is alum+MPL. In some cases, the adjuvant is MF59. In some cases, the adjuvant is alum+MF59. In some cases, the adjuvant is AS01. AS01 contains QS-21 Stimulon® adjuvant, MPL, and liposomes. In some cases, the adjuvant is AS03. A dose of S03 contains: 10.69 mg squalene; 11.86 mg DL-a-tocopherol; and 4.86 mg polysorbate-80. In some cases, the adjuvant is AS04. In some cases, the adjuvant is AS15. AS15 is a combination of QS-21 Stimulon® adjuvant, monophosphoryl lipid A, and CpG7909 (an oligonucleotide of the sequence 5'-TCGTCGTTTTGTCGTTTTGTCGTT-3'; (SEQ ID NO:123), in a liposomal formulation.

Methods of Inducing or Enhancing an Immune Response

The present disclosure provides methods of inducing or enhancing an immune response in an individual, the method comprising administering to the individual an effective amount of an immunogenic composition of the present disclosure, where the immunogenic composition comprises an HCV T-cell epitope polypeptide, and where the immunogenic composition does not include an HCV E1/E2 heterodimer, an HCV E1 polypeptide, or an HCV E2 polypeptide.

Methods of Making an HCV E1/E2 Heterodimer, and for Making A Heterologous Polypeptide An HCV E1/E2 heterodimer, an HCV E2 polypeptide, and a heterologous polypeptide, suitable for inclusion in an immunogenic composition of the present disclosure, can be generated using standard methods for producing a polypeptide in a host cell.

An HCV E1/E2 heterodimer, an HCV E2 polypeptide, and a heterologous polypeptide, suitable for inclusion in an immunogenic composition of the present disclosure, can be produced using any suitable method, including recombinant and non-recombinant methods (e.g., chemical synthesis). An HCV E1/E2 heterodimer, an HCV E2 polypeptide, and a heterologous polypeptide, suitable for inclusion in an immunogenic composition of the present disclosure, can be generated using standard methods for producing a polypeptide in a host cell.

Where a polypeptide is chemically synthesized, the synthesis may proceed via liquid phase or solid-phase. Solid-phase peptide synthesis (SPPS) allows the incorporation of unnatural amino acids and/or peptide/protein backbone modification. Various forms of SPPS, such as Fmoc and Boc, are available for synthesizing polypeptides. Details of the chemical synthesis are known in the art (e.g., Ganesan A. 2006 Mini Rev. Med Chem. 6:3-10 and Camarero J A et al. 2005 Protein Pept Lett. 12:723-8).

Where a polypeptide is produced using recombinant techniques, the polypeptide may be produced as an intracellular protein or as an secreted protein, using any suitable construct and any suitable host cell, which can be a prokaryotic or eukaryotic cell, such as a bacterial (e.g., *Escherichia coli*) cell or a yeast host cell, respectively. Other examples of eukaryotic cells that may be used as host cells include insect cells, mammalian cells, filamentous fungi, and plant cells. Suitable yeast cells include, e.g., *Saccharomyces cerevisiae* and *Pichia* (e.g., *Pichia pastoris*).

In some cases, the heterologous polypeptide is produced separately from (e.g., in a separate host cell) from the HCV E1/E2 heterodimer. In some cases, the heterologous polypeptide is produced is a first host cell; and the HCV E1/E2 heterodimer is produced in a second host cell. Once the HCV E1/E2 heterodimer and the heterologous polypeptide are separately produced, they can be combined, together with a pharmaceutically acceptable excipient, to generate an immunogenic composition of the present disclosure. In some cases, both the HCV E1/E2 heterodimer and the heterologous polypeptide are purified before being combined to generate an immunogenic composition. For example, both the HCV E1/E2 heterodimer and the heterologous polypeptide can be at least 80%, at least 85%, at least 90%, at least 95%, at least 98%, at least 99%, or more than 99%, pure, e.g., free from other polypeptides, other macromolecules, etc.

Methods of Making a Heterologous Polypeptide

A heterologous polypeptide present in an immunogenic composition of the present disclosure can be generated using any known method for making a polypeptide. In some cases, a nucleic acid (e.g., a recombinant expression vector) comprising a nucleotide sequence encoding the heterologous polypeptide is introduced into a host cell, generating a genetically modified (recombinant) host cell, where the recombinant expression vector provides for expression of the heterologous polypeptide in the genetically modified host cell.

In some cases, the heterologous polypeptide is produced as a fusion polypeptide comprising: a) the heterologous polypeptide; and b) a fusion partner, where the fusion partner is an affinity tag. Suitable affinity tags include, e.g., immunoglobulin Fc polypeptides, a poly(histidine) tag (e.g., $His_6$), a maltose binding protein (MBP), a glutathione-S-transferase (GST) polypeptide, calmodulin-binding peptide (CBP), Streptavidin-binding peptide (SBP), Strep-tag II, FLAG (e.g., DYKDDDDK (SEQ ID NO:91), hemagglutinin (HA) (e.g., YPYDVPDYA (SEQ ID NO:92), c-myc T7 ((e.g., EQKLISEEDL; SEQ ID NO:93), Glu-Glu, starch-binding domain (SBD), and Flag-Acidic-Target Tag (FATT), and the like.

In some cases, the heterologous polypeptide is produced as a fusion polypeptide comprising: a) the heterologous polypeptide; and b) a fusion partner (e.g., where the fusion partner is an Ig Fc polypeptide). In some cases, a proteolytically cleavable linker is interposed between the heterologous polypeptide and the fusion partner, such that the fusion polypeptide comprises: a) the heterologous polypeptide; b) the proteolytically cleavable linker; and c) the fusion partner (e.g., Ig Fc polypeptide).

The proteolytically cleavable linker can include a protease recognition sequence recognized by a protease selected from the group consisting of alanine carboxypeptidase, *Armillaria mellea* astacin, bacterial leucyl aminopeptidase, cancer procoagulant, cathepsin B, clostripain, cytosol alanyl aminopeptidase, elastase, endoproteinase Arg-C, enterokinase, gastricsin, gelatinase, Gly-X carboxypeptidase, glycyl endopeptidase, human rhinovirus 3C protease, hypodermin C, IgA-specific serine endopeptidase, leucyl aminopeptidase, leucyl endopeptidase, lysC, lysosomal pro-X carboxypeptidase, lysyl aminopeptidase, methionyl aminopeptidase, myxobacter, nardilysin, pancreatic endopeptidase E, picornain 2A, picornain 3C, proendopeptidase, prolyl aminopeptidase, proprotein convertase I, proprotein convertase II, russellysin, saccharopepsin, semenogelase, T-plasminogen activator, thrombin, tissue kallikrein, tobacco etch virus (TEV), togavirin, tryptophanyl aminopeptidase, U-plasminogen activator, V8, venombin A, venombin AB, and Xaa-pro aminopeptidase.

For example, the proteolytically cleavable linker can comprise a matrix metalloproteinase cleavage site, e.g., a cleavage site for a MMP selected from collagenase-1, -2, and -3 (MMP-1, -8, and -13), gelatinase A and B (MMP-2 and -9), stromelysin 1, 2, and 3 (MMP-3, -10, and -11), matrilysin (MMP-7), and membrane metalloproteinases (MT1-MMP and MT2-MMP). For example, the cleavage sequence of MMP-9 is Pro-X-X-Hy (wherein, X represents an arbitrary residue; Hy, a hydrophobic residue), e.g., Pro-X-X-Hy-(Ser/Thr), e.g., Pro-Leu/Gln-Gly-Met-Thr-Ser (SEQ ID NO:125) or Pro-Leu/Gln-Gly-Met-Thr (SEQ ID NO:75). Another example of a protease cleavage site is a plasminogen activator cleavage site, e.g., a uPA or a tissue plasminogen activator (tPA) cleavage site. In some cases, the cleavage site is a furin cleavage site. Specific examples of cleavage sequences of uPA and tPA include sequences comprising Val-Gly-Arg. Another example of a protease cleavage site that can be included in a proteolytically cleavable linker is a tobacco etch virus (TEV) protease cleavage site, e.g., ENLYTQS (SEQ ID NO:126), where the protease cleaves between the glutamine and the serine. Another example of a protease cleavage site that can be included in a proteolytically cleavable linker is an enterokinase cleavage site, e.g., DDDDK (SEQ ID NO:77), where cleavage occurs after the lysine residue. Another example of a protease cleavage site that can be included in a proteolytically cleavable linker is a thrombin cleavage site, e.g., LVPR (SEQ ID NO:78). Additional suitable linkers comprising protease cleavage sites include linkers comprising one or more of the following amino acid sequences: LEVLFQGP (SEQ ID NO:65), cleaved by PreScission protease (a fusion protein comprising human rhinovirus 3C protease and glutathione-S-transferase; Walker et al. (1994) *Biotechnol.* 12:601); a thrombin cleavage site, e.g., CGLVPAGSGP (SEQ ID NO:79); SLLKSRMVPNFN (SEQ ID NO:80) or SLLIARRMPNFN (SEQ ID NO:82), cleaved by cathepsin B; SKLVQASASGVN (SEQ ID NO:74) or SSYLKASDAPDN (SEQ ID NO:70), cleaved by an Epstein-Barr virus protease; RPKPQQFFGLMN (SEQ ID NO:71) cleaved by MMP-3 (stromelysin); SLRPLALWRSFN (SEQ ID NO:127) cleaved by MMP-7 (matrilysin); SPQGIAGQRNFN (SEQ ID NO:72) cleaved by MMP-9; DVDERDVRGFASFL SEQ ID NO:73) cleaved by a thermolysin-like MMP; SLPLGLWAPNFN (SEQ ID NO:124) cleaved by matrix metalloproteinase 2 (MMP-2); SLLIFRSWANFN (SEQ ID NO:128) cleaved by cathespin L; SGVVIATVIVIT (SEQ ID NO:129) cleaved by cathepsin D; SLGPQGIWGQFN (SEQ ID NO:130) cleaved by matrix metalloproteinase 1 (MMP-1); KKSPGRVVGGSV (SEQ ID NO:131) cleaved by urokinase-type plasminogen activator; PQGLLGAPGILG (SEQ ID NO:132) cleaved by membrane type 1 matrixmetalloproteinase (MT-MMP); HGPEGLRVGFYESDVMGRGHARLVHVEEPHT (SEQ ID NO:133) cleaved by stromelysin 3 (or MMP-11), thermolysin, fibroblast collagenase and stromelysin-1; GPQGLAGQRGIV (SEQ ID NO:134) cleaved by matrix metalloproteinase 13 (collagenase-3); GGSGQRGRKALE (SEQ ID NO:135) cleaved by tissue-type plasminogen activator(tPA); SLSALLSSDIFN (SEQ ID NO:136) cleaved by human prostate-specific antigen; SLPRFKIIGGFN (SEQ ID NO:137) cleaved by kallikrein (hK3); SLLGIAVPGNFN (SEQ ID NO:138) cleaved by neutrophil elastase; and FFKNIVTPRTPP (SEQ ID NO:139) cleaved by calpain (calcium activated neutral protease).

Depending on the proteolytically cleavable linker, a heterologous polypeptide (a T-cell epitope polypeptide) can comprise, at its N-terminus or at its C-terminus, from 1 to 6 additional amino acids that are N-terminal or C-terminal to the cleavage site of the proteolytically cleavable linker. The following are non-limiting examples. In some cases, a heterologous polypeptide (a T-cell epitope polypeptide) is a modified T-cell epitope polypeptide that comprises from 1 to 6 additional amino acids at the N-terminus of the modified T-cell epitope polypeptide, where the from 1 to 6 additional amino acids are Gly-Pro, Ser, Gly, or Gly-Ser. In some cases, a heterologous polypeptide (a T-cell epitope polypeptide) is a modified T-cell epitope polypeptide that comprises from 1 to 6 additional amino acids at the C-terminus of the modified T-cell epitope polypeptide, where the from 1 to 6 additional amino acids are LEVLFQ (SEQ ID NO:76), ENLYYFQ (SEQ ID NO:83), LVPR (SEQ ID NO:78), I(E/D)GR (SEQ ID NO:90), or DDDDK (SEQ ID NO:77).

The Fc region can be a human IgG1 Fc, a human IgG2 Fc, a human IgG3 Fc, a human IgG4 Fc, etc. In some cases, the Fc region comprises an amino acid sequence having at least about 70%, at least about 75%, at least about 80%, at least about 85%, at least about 90%, at least about 95%, at least about 98%, at least about 99%, or 100%, amino acid sequence identity to an amino acid sequence of an Fc region depicted in FIG. 5A-5C. In some cases, the Fc region comprises an amino acid sequence having at least about 70%, at least about 75%, at least about 80%, at least about 85%, at least about 90%, at least about 95%, at least about 98%, at least about 99%, or 100%, amino acid sequence identity to the human IgG1 Fc polypeptide depicted in FIG. 5A. In some cases, the Fc region comprises an amino acid sequence having at least about 70%, at least about 75%, at least about 80%, at least about 85%, at least about 90%, at least about 95%, at least about 98%, at least about 99%, or 100%, amino acid sequence identity to the human IgG2 Fc polypeptide depicted in FIG. 5A; e.g., the Fc region comprises an amino acid sequence having at least about 70%, at least about 75%, at least about 80%, at least about 85%, at least about 90%, at least about 95%, at least about 98%, at least about 99%, or 100%, amino acid sequence identity to amino acids 99-325 of the human IgG2 Fc polypeptide depicted in FIG. 5A. In some cases, the Fc region comprises an amino acid sequence having at least about 70%, at least about 75%, at least about 80%, at least about 85%, at least about 90%, at least about 95%, at least about 98%, at least about 99%, or 100%, amino acid sequence identity to the human IgG3 Fc polypeptide depicted in FIG. 5A; e.g., the Fc region comprises an amino acid sequence having at least about 70%, at least about 75%, at least about 80%, at least about 85%, at least about 90%, at least about 95%, at least about 98%, at least about 99%, or 100%, amino acid sequence identity to amino acids 19-246 of the human IgG3 Fc polypeptide depicted in FIG. 5A.

Suitable expression vectors include, but are not limited to, baculovirus vectors, bacteriophage vectors, plasmids, phagemids, cosmids, fosmids, bacterial artificial chromosomes, viral vectors (e.g. viral vectors based on vaccinia virus, poliovirus, adenovirus, adeno-associated virus, SV40, herpes simplex virus, human immunodeficiency virus-based lentivirus vectors, murine leukemia virus (MVL)-based gamma retrovirus vectors, and the like), P1-based artificial chromosomes, yeast plasmids, yeast artificial chromosomes, and any other vectors specific for specific hosts of interest (such as *Escherichia coli*, mammalian cells, insect cells, or yeast cells).

Suitable host cells include eukaryotic cells, such as yeast cells, insect cells, and mammalian cells. In some cases, the host cell is a cell of a mammalian cell line. Suitable mammalian cell lines include human cell lines, non-human primate cell lines, rodent (e.g., mouse, rat) cell lines, and the like.

Suitable prokaryotic cells include, but are not limited to, any of a variety of laboratory strains of *Escherichia coli, Lactobacillus* sp., *Salmonella* sp., *Shigella* sp., and the like. See, e.g., Carrier et al. (1992) *J. Immunol.* 148:1176-1181; U.S. Pat. No. 6,447,784; and Sizemore et al. (1995) *Science* 270:299-302.

Suitable eukaryotic host cells include, but are not limited to, *Pichia pastoris, Pichia finlandica, Pichia trehalophila, Pichia koclamae, Pichia membranaefaciens, Pichia opuntiae, Pichia thermotolerans, Pichia salictaria, Pichia guercuum, Pichia pijperi, Pichia stiptis, Pichia methanolica, Pichia* sp., *Saccharomyces cerevisiae, Saccharomyces* sp., *Hansenula polymorpha, Kluyveromyces* sp., *Kluyveromyces lactic, Candida albicans, Aspergillus nidulans, Aspergillus niger, Aspergillus oryzae, Trichoderma reesei, Chrysosporium lucknowense, Fusarium* sp., *Fusarium gramineum, Fusarium venenatum, Neurospora crassa, Chlamydomonas reinhardtii*, and the like. Suitable yeast cells include, e.g., *Saccharomyces cerevisiae* and *Pichia* (e.g., *Pichia pastoris*).

Suitable insect cells include, e.g., *Spodoptera frugiperda* cells, e.g., Sf9 cells; *Spodoptera frugiperda* Sf-21 cells; *Trichoplusia ni* cells (e.g., Tn-368 cells; High-Five™ BTI-TN5B1-4 cells); etc.

Suitable mammalian cell lines include, but are not limited to, HeLa cells (e.g., American Type Culture Collection (ATCC) No. CCL-2), CHO cells (e.g., ATCC Nos.

CRL9618, CCL61, CRL9096), 293 cells (e.g., ATCC No. CRL-1573), Vero cells, NIH 3T3 cells (e.g., ATCC No. CRL-1658), Huh-7 cells, BHK cells (e.g., ATCC No. CCL10), PC12 cells (ATCC No. CRL1721), COS cells, COS-7 cells (ATCC No. CRL1651), RAT1 cells, mouse L cells (ATCC No. CCLI.3), human embryonic kidney (HEK) cells (ATCC No. CRL1573), HLHepG2 cells, MRC4 fibroblast cells, and the like.

Methods for introduction of nucleic acids into host cells include, for example, transformation, electroporation, conjugation, calcium phosphate methods and the like. The method for transfer can be selected so as to provide for stable expression of the introduced polypeptide-encoding nucleic acid. The polypeptide-encoding nucleic acid can be provided as an inheritable episomal element (e.g., a plasmid) or can be genomically integrated.

In some cases, the heterologous polypeptide is produced in a genetically modified host cell; and the heterologous polypeptide is purified from one or more of the cell culture medium and a cell lysate made from the genetically modified host cell. Methods of purifying a polypeptide from cell culture medium and/or a cell lysate are known in the art and include, e.g., affinity chromatography, size exclusion chromatography, In some cases, where the heterologous polypeptide is a fusion protein comprising the heterologous polypeptide and a fusion partner, the fusion protein is purified on an affinity column comprising an antibody specific for the fusion partner, or other affinity partner that binds the fusion partner, immobilized on an insoluble support. In some cases, where the heterologous polypeptide is a fusion protein comprising the heterologous polypeptide and a fusion partner, and where the fusion partner is an Ig Fc polypeptide, the fusion protein can be purified on a Protein A column (i.e., affinity chromatography using Protein A immobilized on an insoluble support).

In some cases, where the heterologous polypeptide is a fusion protein comprising the heterologous polypeptide and a fusion partner, and where the fusion partner is an Ig Fc polypeptide, and where a proteolytically cleavable linker is interposed between the Ig Fc and the heterologous polypeptide, the fusion protein can be purified on a Protein A column (i.e., affinity chromatography using Protein A immobilized on an insoluble support). The fusion protein can be immobilized on the Protein A column; and an enzyme that cleaves a proteolytic cleavage site in the proteolytically cleavable linker is applied to the column comprising the immobilized fusion protein; the enzyme releases the heterologous polypeptide from the Protein A column.

Methods of Making an HCV E1/E2 Heterodimer

An HCV E1/E2 heterodimer can be produced using any suitable method, including recombinant and non-recombinant methods (e.g., chemical synthesis).

Where a polypeptide is chemically synthesized, the synthesis may proceed via liquid phase or solid-phase. Solid-phase peptide synthesis (SPPS) allows the incorporation of unnatural amino acids and/or peptide/protein backbone modification. Various forms of SPPS, such as Fmoc and Boc, are available for synthesizing polypeptides. Details of the chemical synthesis are known in the art (e.g., Ganesan A. 2006 Mini Rev. Med Chem. 6:3-10 and Camarero J A et al. 2005 Protein Pept Lett. 12:723-8).

Where a polypeptide is produced using recombinant techniques, the polypeptide may be produced as an intracellular protein or as an secreted protein, using any suitable construct and any suitable host cell, which can be a prokaryotic or eukaryotic cell, such as a bacterial (e.g., *Escherichia coli*) cell or a yeast host cell, respectively. Other examples of eukaryotic cells that may be used as host cells include insect cells, mammalian cells, filamentous fungi, and plant cells. Suitable yeast cells include, e.g., *Saccharomyces cerevisiae* and *Pichia* (e.g., *Pichia pastoris*).

Suitable mammalian cells include human cell lines, non-human primate cell lines, rodent (e.g., mouse, rat) cell lines, and the like. Suitable mammalian cell lines include, but are not limited to, HeLa cells (e.g., American Type Culture Collection (ATCC) No. CCL-2), CHO cells (e.g., ATCC Nos. CRL9618, CCL61, CRL9096), 293 cells (e.g., ATCC No. CRL-1573), Vero cells, NIH 3T3 cells (e.g., ATCC No. CRL-1658), Huh-7 cells, BHK cells (e.g., ATCC No. CCL10), PC12 cells (ATCC No. CRL1721), COS cells, COS-7 cells (ATCC No. CRL1651), RAT1 cells, mouse L cells (ATCC No. CCLI.3), human embryonic kidney (HEK) cells (ATCC No. CRL1573), HLHepG2 cells, MRC5 cells (ATCC No. CCL-171), and the like. Where mammalian host cells are used, such host cells may include human cells (e.g., HeLa, 293, H9 and Jurkat cells); mouse cells (e.g., NIH3T3, L cells, and C127 cells); primate cells (e.g., Cos 1, Cos 7 and CV1); MRC4 cells; and hamster cells (e.g., Chinese hamster ovary (CHO) cells).

A variety of host-vector systems suitable for the expression of a polypeptide may be employed according to standard procedures known in the art. See, e.g., Sambrook et al., 1989 Current Protocols in Molecular Biology Cold Spring Harbor Press, New York; Ausubel et al. 1995 Current Protocols in Molecular Biology, Eds. Wiley and Sons; "Protein Expression: A Practical Approach" (1999) S. J. Higgins and B. D. James, eds., Oxford University Press; "Protein Expression in Mammalian Cells: Methods and Protocols (Methods in Molecular Biology)" (2012) James L. Hartley, ed., Humana Press; and "Production of Recombinant Proteins" (2005) Gerd Gellisen, ed., Wiley-VCH. Methods for introduction of nucleic acids into host cells include, for example, transformation, electroporation, conjugation, calcium phosphate methods and the like. The method for transfer can be selected so as to provide for stable expression of the introduced polypeptide-encoding nucleic acid. The polypeptide-encoding nucleic acid can be provided as an inheritable episomal element (e.g., a plasmid) or can be genomically integrated. A variety of appropriate vectors for use in production of a peptide of interest are available commercially.

Suitable expression vectors include, but are not limited to, baculovirus vectors, bacteriophage vectors, plasmids, phagemids, cosmids, fosmids, bacterial artificial chromosomes, viral vectors (e.g. viral vectors based on vaccinia virus, poliovirus, adenovirus, adeno-associated virus, SV40, herpes simplex virus, HIV-based lentivirus vectors, murine leukemia virus (MVL)-based gamma retrovirus vectors, and the like), P1-based artificial chromosomes, yeast plasmids, yeast artificial chromosomes, and any other vectors specific for specific hosts of interest (such as *E. coli*, mammalian cells, insect cells, or yeast cells).

An E1 polypeptide, an E2 polypeptide, or an E1/E2 heterodimer can be produced by introducing a recombinant expression vector comprising a nucleotide sequence encoding the E1 polypeptide, E2 polypeptide, or E1/E2 heterodimer into an appropriate host cell, where the host cell produces the encoded E1 polypeptide, E2 polypeptide, or E1/E2 heterodimer. In the expression vector, a polynucleotide comprising a nucleotide sequence(s) encoding the E1 polypeptide, E2 polypeptide, or E1/E2 heterodimer is linked to a regulatory sequence as appropriate to obtain the desired expression properties. These regulatory sequences can include promoters, enhancers, terminators, operators, repressors, and inducers. The promoters can be regulated or constitutive. Expression vectors generally have convenient restriction sites located near the promoter sequence to provide for the insertion of nucleic acid sequences encoding a protein of interest. A selectable marker operative in the expression host cell may be present.

In some cases, the E1/E2 heterodimer is encoded in a recombinant expression vector suitable for expression in a eukaryotic host cell (e.g., an insect cell; a yeast cell; a mammalian host cell, such as CHO cells, HeLa cells, 293 cells, MRC5 cells, etc.). In some cases, a recombinant expression vector comprises a nucleotide sequence encoding E1 and E2 polypeptides (which may be wild-type or variant) as a single polypeptide chain; the recombinant expression vector is introduced into a eukaryotic host cell to generate a genetically modified host cell. In some cases, E1 and E2 polypeptides are initially produced as a single polypeptide chain, which is cleaved in the endoplasmic reticulum (ER) of the genetically modified host cell to produce separate E1 and E2 polypeptides. The separate E1 and E2 polypeptides can form a heterodimer (e.g., a non-covalently linked heterodimer) in the ER. The E1/E2 heterodimer can be isolated from the genetically modified host cell by, e.g., lysis using a non-ionic detergent, or using a freeze-thaw method. See, e.g., Frey et al. (2010) Vaccine 28:6367. The E1/E2 heterodimer can be purified from a cell lysate and/or cell culture medium using any of a variety of methods, including size exclusion chromatography, affinity chromatography, and the like, or combinations of such methods. In some cases, the E1/E2 heterodimer is purified from cell lysate and/or cell culture medium using *Galanthus nivalis* (GNA) lectin affinity chromatography. In some cases, the E1/E2 heterodimer is purified from a cell lysate. In some cases, the E1/E2 heterodimer is secreted from a cell and is purified from the cell culture medium. Suitable methods that can be used for purifying an E1/E2 heterodimer are described in, e.g., U.S. Pat. Nos. 6,121,020; 6,274,148; and Mazzocca et al. (2005) *J. Biol. Chem.* 280:11329. For example, in some cases, an E1/E2 heterodimer can be prepared in a method comprising cell disruption and debris removal by microfiltration, followed by purification using three subsequent chromatographic steps: lectin affinity chromatography, hydroxyapatite chromatography, and ion exchange chromatography.

Alternatively, the E1 and E2 polypeptides can be encoded on separate recombinant expression vectors; and produced in a cell (e.g., the same host cell or separate host cells) as separate polypeptides.

If full-length E1 and E2 polypeptides are expressed in a eukaryotic host cell, the E1 and E2 polypeptides remain bound to the endoplasmic reticulum (ER) membrane as asialoglycoproteins. If the E1 and E2 polypeptides have C-terminal truncations, such that the C-terminal transmembrane regions are removed, the truncated polypeptides are secreted and can acquire complex glycans such as sialic acid. Removal of approximately amino acids 660-746 of E2, or amino acids 715-746 of E2, and removal of approximately amino acids 330-383 of E1, results in secretion of E2 and E1 from a eukaryotic host cell. If E1 and E2 are co-expressed in the same eukaryotic host cell as full-length polypeptides, they remain in the lumen of the ER as a heterodimer.

In some cases, an E2 polypeptide suitable for use in an E1/E2 heterodimer lacks a transmembrane region. For example, in some cases, an E2 polypeptide suitable for use in an E1/E2 heterodimer, comprises amino acids 384-659, and lacks amino acids 660-746 of a naturally-occurring E2 polypeptide; and may be referred to as "E2 ectodomain polypeptide." For example, in some cases, an E2 polypeptide suitable for use in an E1/E2 heterodimer comprises amino acids 384-659, lacks amino acids 660-746 of a naturally-occurring E2 polypeptide, and has a length of 276 amino acids.

In some cases, an E1 polypeptide suitable for use in an E1/E2 heterodimer lacks a transmembrane region. For example, in some cases, an E1 polypeptide suitable for use in an E1/E2 heterodimer comprises amino acids 191-329, and lacks amino acids 330-383 of a naturally-occurring E1 polypeptide; and may be referred to as an "E1 ectodomain polypeptide." For example, in some cases, an E1 polypeptide suitable for use in an E1/E2 heterodimer comprises amino acids 191-329, lacks amino acids 330-383 of a naturally-occurring E1 polypeptide, and has a length of 139 amino acids.

After production in a host cell, an E1 polypeptide, an E2 polypeptide, or an E1/E2 heterodimer (e.g., as separate polypeptides or as a heterodimer) can be purified from the host cell. Methods of purification of recombinantly produced polypeptides from a host cell are known in the art and include, e.g., detergent lysis (e.g., with a non-ionic detergent) or freeze-thaw lysis, followed by one or more of size exclusion column chromatography, high performance liquid chromatography, affinity chromatography, and the like.

In some cases, an E1/E2 heterodimer suitable for inclusion in an immunogenic composition of the present disclosure is produced by purifying an E1/E2 heterodimer on an affinity column, where the E1 or E2 polypeptide comprises an Ig Fc polypeptide linked to the E1 or E2 polypeptide via a proteolytically cleavable linker. For example, the method can comprise: A) culturing a genetically modified eukaryotic host cell that is genetically modified with a nucleic acid (e.g., recombinant expression vector) comprising a nucleotide sequence encoding an E1/E2 polypeptide that comprises, in order from N-terminus to C-terminus: a) a signal peptide that directs the E1/E2 polypeptide to the ER following translation of the E1/E2 polypeptide; b) an HCV E1 polypeptide; c) an Ig Fc region; d) a proteolytically cleavable linker; and e) an HCV E2 polypeptide); B) contacting a lysate of the cultured genetically modified eukaryotic host cell with a solid support comprising an Ig Fc binding moiety, generating an immobilized heterodimer comprising the HCV E1 polypeptide and a fusion polypeptide comprising: a) the Ig Fc; b) the proteolytically cleavable linker; and c) the E2 polypeptide; C) contacting the immobilized heterodimer with an enzyme that cleaves the proteolytically cleavable linker, thereby releasing the heterodimer; and D) collecting the released heterodimer.

In some cases, an E1/E2 heterodimer of the present disclosure is produced using a method comprising: A) culturing a genetically modified eukaryotic host cell that is genetically modified with a nucleic acid (e.g., recombinant expression vector) comprising a nucleotide sequence encoding an E1/E2 polypeptide that comprises, in order from N-terminus to C-terminus: a) a signal peptide that directs the E1/E2 polypeptide to the ER following translation of the E1/E2 polypeptide; b) an HCV E1 polypeptide; c) an Ig Fc region; d) a proteolytically cleavable linker; and e) an HCV E2 polypeptide; B) contacting a lysate of the cultured genetically modified eukaryotic host cell with a solid support comprising an Ig Fc binding moiety, generating an immobilized heterodimer comprising the HCV E1 polypeptide and a fusion polypeptide comprising: a) the Ig Fc; b) the proteolytically cleavable linker; and c) the E2 polypeptide; C) contacting the immobilized heterodimer with an enzyme that cleaves the proteolytically cleavable linker, thereby releasing the heterodimer; and D) collecting the released heterodimer.

In some cases, an E1/E2 heterodimer of the present disclosure is produced using a method comprising: A) culturing a genetically modified eukaryotic host cell that is genetically modified with a nucleic acid (e.g., recombinant expression vector) comprising a nucleotide sequence encoding an E1/E2 polypeptide that comprises, in order from N-terminus to C-terminus: a) a signal peptide that directs the E1/E2 polypeptide to the ER following translation of the E1/E2 polypeptide; b) an HCV E1 polypeptide; c) an Ig Fc region; d) a proteolytically cleavable linker comprising the amino acid sequence LEVLFQGP (SEQ ID NO:65), and having a length of from 8 amino acids to 15 amino acids; and e) an HCV E2 polypeptide; B) contacting a lysate of the cultured genetically modified eukaryotic host cell with a solid support comprising an Ig Fc binding moiety, generating an immobilized heterodimer comprising the HCV E1 polypeptide and a fusion polypeptide comprising: a) the Ig Fc; b) the proteolytically cleavable linker; and c) the E2 polypeptide; C) contacting the immobilized heterodimer with an enzyme (e.g., a rhinovirus 3C protease) that cleaves the proteolytically cleavable linker, thereby releasing the heterodimer; and D) collecting the released heterodimer.

In some cases, an E1/E2 heterodimer of the present disclosure is produced using a method comprising: A) culturing a genetically modified eukaryotic host cell that is genetically modified with a nucleic acid (e.g., recombinant expression vector) comprising a nucleotide sequence encoding an E1/E2 polypeptide that comprises, in order from N-terminus to C-terminus: a) a signal peptide that directs the E1/E2 polypeptide to the ER following translation of the E1/E2 polypeptide; b) an HCV E1 polypeptide; c) an Ig Fc region; d) a proteolytically cleavable linker comprising the amino acid sequence LEVLFQGP (SEQ ID NO:65), and having a length of from 8 amino acids to 15 amino acids; and e) an HCV E2 polypeptide; B) contacting a lysate of the cultured genetically modified eukaryotic host cell with a solid support comprising an Ig Fc binding moiety, generating an immobilized heterodimer comprising the HCV E1 polypeptide and a fusion polypeptide comprising: a) the Ig Fc; b) the proteolytically cleavable linker; and c) the E2 polypeptide; C) contacting the immobilized heterodimer with an enzyme (e.g., a fusion polypeptide comprising a glutathione-S-transferase and a human rhinovirus 3C protease (GST-HRV3C protease)) that cleaves the proteolytically cleavable linker, thereby releasing the E1E2 heterodimer; and D) collecting the released E1E2 heterodimer. In some cases, a solution comprising the released E1E2 heterodimer is applied to glutathione immobilized on a solid support, to remove the GST-HRV3C protease. For example, a solution comprising the released heterodimer can be applied to a glutathione-Sepharose 4B column, where the GST-HRV3C binds to the glutathione-Sepharose 4B; the flow-through (unbound material) comprises the released E1E2 heterodimer. In some cases, the released E1E2 heterodimer is further subjected to hydroxyapatite chromatography. Hydroxyapatite chromatography can be carried out as described in, e.g., Mazzocca et al. (2005) *J. Biol. Chem.* 280:11329.

Suitable Ig Fc binding moieties include, but are not limited to, Protein A (Graille et al. (2000) *Proc. Natl. Acad. Sci. USA* 97:5399); Protein G (Sjobring et al. (1991) *J. Biol. Chem.* 266:399); and a Protein A/G fusion polypeptide (Eliasson et al. (1988) *J. Biol. Chem.* 263:4323).

The Ig Fc binding moiety can be immobilized onto a solid support, where the solid support can be of any of a variety of forms, e.g., a bead, a magnetic bead, a plate, and the like. The solid support can be made of any of a variety of materials, including, but not limited to, polystyrene, agarose, polyesters, polyethylene, and the like.

As an alternative to Fc, an affinity tag such as, e.g., polyhistidine (e.g., $(His)_6$), glutathione-S-transferase (GST), calmodulin-binding peptide (CBP), Streptavidin-binding peptide (SBP), Strep-tag II, FLAG (e.g., DYKDDDDK (SEQ ID NO:91), hemagglutinin (HA) (e.g., YPYDVPDYA (SEQ ID NO:92), c-myc T7 ((e.g., EQKLISEEDL; SEQ ID NO:93), Glu-Glu, and the like, can be used. (Wood D. 2014. *Current Opinion in Structural Biology* 26 54-61; Kimple M E et al. 2013. *Current Protocols in Protein Science* 9.9.1-9.9.23). Other suitable affinity tags include, e.g., starch-binding domain (SBD); and Flag-Acidic-Target Tag (FATT). See, e.g., Wood D. 2014. *Current Opinion in Structural Biology* 26 54-61).

One or more additional purification steps can be carried out. For example, a solution comprising the released heterodimer, produced as described above, can be subjected to size exclusion chromatography, hydroxyapatite chromatography, and the like. Hydroxyapatite chromatography can be carried out as described in, e.g., Mazzocca et al. (2005) *J. Biol. Chem.* 280:11329.

An E1/E2 heterodimer of the present disclosure can be purified such that the E1/E2 heterodimer is at least 60% pure, at least 65% pure, at least 70% pure, at least 75% pure, at least 80% pure, at least 85% pure, at least 90% pure, at least 95% pure, at least 98% pure, at least 99% pure, or greater than 99% pure.

Nucleic Acid Immunogenic Compositions

The present disclosure provides nucleic acid compositions comprising: a) one or more nucleic acids comprising a nucleotide sequence(s) encoding polypeptides (e.g., HCV E1/E2; HCV E1; HCV E2; T-cell epitope polypeptide) as described above. The present disclosure provides an immunogenic composition comprising: a) a nucleic acid (e.g., a recombinant viral expression vector(s)) comprising nucleotide sequence(s) encoding one or more of: an HCV E1/E2 heterodimer; an HCV E1 polypeptide; an HCV E2 polypeptide; and a T-cell epitope polypeptide, where such polypeptides are described above. The polypeptides can be encoded in the same nucleic acid, or on separate nucleic acids. For example, where the nucleic acid(s) are recombinant expression vectors, the polypeptides can be encoded in the same or separate recombinant expression vectors.

In some cases, the nucleic acid(s) is/are DNA. In some cases, the nucleic acid(s) is/are RNA. In some cases, the nucleic acid(s) is/are present in expression vector(s), generating recombinant expression vector(s) comprising the nucleic acid(s). In some cases, the recombinant expression vector(s) is/are recombinant bacterial vectors. In some cases, the recombinant expression vector(s) is/are recombinant viral vector(s). In some cases, the recombinant viral vector (s) are packaged into viral particles. In some cases, the nucleic acid(s) are present in bacteria (e.g., non-pathogenic bacteria (e.g., attenuated bacteria) suitable for delivery of nucleic acids to an individual). Where the recombinant expression vector is a bacterial vector or a viral vector, the vector is suitably attenuated so as not to cause significant pathology in an individual.

In some cases, the nucleic acid is present in an expression vector. Suitable expression vectors include, but are not limited to, a replication-defective adenovirus vector; a replication-defective vaccinia virus vector; a lentivirus vector (e.g., a self-inactivating lentivirus vector); a retroviral vector (e.g., a self-inactivating retroviral vector); an adeno-associated virus vector; and the like. In some cases, the vector is a modified vaccinia Ankara (MVA) vector, or an MVA-based vector (see, e.g., Verheust et al. (2012) *Vaccine* 30:2623). In some cases, the vector is a replication-defective adenovirus vector. In some cases, the vector is a replication-defective adenovirus 6 (Ad6) vector. In some cases, the vector is a replication-defective simian adenovirus vector (e.g., ChAd3). Suitable viral vectors are described in, e.g., Thou et al. (2012) *Invest. Ophthalmol. Vis. Sci.* 53:2804; Swadling et al. (2014) *Sci. Transl. Med.* 6:261ra153; and Choi and Chang (2013) *Clin. Exp. Vaccine Res.* 2:97. In many cases, the recombinant viral vectors are packaged into viral particles; and the viral particles are formulated in an immunogenic composition along with a pharmaceutically acceptable carrier. Suitable pharmaceutically acceptable carriers are described above.

In some cases, an immunogenic composition of the present disclosure comprises: a) a recombinant viral vector comprising nucleotide sequences encoding one or more of: an HCV E1/E2 heterodimer; an HCV E1 polypeptide; an HCV E2 polypeptide; and a T-cell epitope polypeptide; and b) a pharmaceutically acceptable excipient. In some cases, an immunogenic composition of the present disclosure comprises: a) a recombinant viral vector comprising nucleotide sequences encoding: an HCV E1/E2 heterodimer; and a T-cell epitope polypeptide; and b) a pharmaceutically acceptable excipient. In some cases, an immunogenic composition of the present disclosure comprises: a) a recombinant viral vector comprising nucleotide sequences encoding: an HCV E1 polypeptide; and a T-cell epitope polypeptide; and b) a pharmaceutically acceptable excipient. In some cases, an immunogenic composition of the present disclosure comprises: a) a recombinant viral vector comprising nucleotide sequences encoding: an HCV E2 polypeptide; and a T-cell epitope polypeptide; and b) a pharmaceutically acceptable excipient.

In some cases, the present disclosure provides: a) a first immunogenic composition comprising: i) a recombinant viral vector comprising nucleotide sequences encoding one or more of: an HCV E1/E2 heterodimer; an HCV E1 polypeptide; an HCV E2 polypeptide; and a T-cell epitope polypeptide; and ii) a pharmaceutically acceptable excipient; and b) a second immunogenic composition comprising: i) a recombinant viral vector comprising nucleotide sequences encoding one or more of: an HCV E1/E2 heterodimer; an HCV E1 polypeptide; an HCV E2 polypeptide; and a T-cell epitope polypeptide; and ii) a pharmaceutically acceptable excipient.

In some cases, the present disclosure provides: a) a first immunogenic composition comprising: i) a first recombinant viral vector comprising nucleotide sequences encoding one or more of: an HCV E1/E2 heterodimer; an HCV E1 polypeptide; an HCV E2 polypeptide; and a T-cell epitope polypeptide; and ii) a pharmaceutically acceptable excipient; and b) a second immunogenic composition comprising: i) a second recombinant viral vector comprising nucleotide sequences encoding one or more of: an HCV E1/E2 heterodimer; an HCV E1 polypeptide; an HCV E2 polypeptide; and a T-cell epitope polypeptide; and ii) a pharmaceutically acceptable excipient. In some cases, the first recombinant viral vector is a replication-defective adenovirus-based recombinant viral vector; and the second recombinant viral vector is an MVA-based recombinant viral vector. In some cases, the first recombinant viral vector is a chimpanzee adenovirus-based recombinant viral vector; and the second recombinant viral vector is an MVA-based recombinant viral vector.

In some cases, the nucleic acid(s) are present in bacteria (e.g., non-pathogenic bacteria suitable for delivery of nucleic acids to an individual). In some cases, the nucleic acid(s) are present in recombinant expression vector(s) present in bacteria (e.g., non-pathogenic bacteria suitable for delivery of nucleic acids to an individual). Thus, the present disclosure provides an immunogenic composition comprising a non-pathogenic, bacterium that harbors a nucleic acid(s) comprising nucleotide sequences encoding one or more of: an HCV E1/E2 heterodimer; an HCV E1 polypeptide; an HCV E2 polypeptide; and a T-cell epitope polypeptide, where such polypeptides are described above. The present disclosure provides an immunogenic composition comprising a non-pathogenic bacterium that harbors a recombinant expression vector(s) comprising nucleotide sequences encoding one or more of: an HCV E1/E2 heterodimer; an HCV E1 polypeptide; an HCV E2 polypeptide; and a T-cell epitope polypeptide, where such polypeptides are described above. In some cases, the bacteria are live. In some cases, the bacteria are live attenuated bacteria. In some cases, the bacteria are killed.

Bacteria suitable for delivery of nucleic acid(s) (which nucleic acid(s) may be present in expression vector(s)) include, but are not limited to, *Lactobacillus; Lactococcus* (e.g., *Lactococcus* lactic); *Salmonella*, e.g., attenuated, non-pathogenic *Salmonella*, e.g., *Salmonella enterica* serovar *Typhi, Salmonella enterica* serovar *Typhimurium*; non-pathogenic strains of *Francisella*; non-pathogenic strains of *Escherichia coli*; non-pathogenic strains of *Bordetella pertussis*; non-pathogenic strains of *Listeria*; non-pathogenic strains of *Shigella*; non-pathogenic strains of *Vibrio* (e.g., *Vibrio cholera*); *Streptococcus gordonii*; non-pathogenic strains of *Yersinia enterocolitica*; non-pathogenic strains of *Shigella flexneri*; non-pathogenic strains of *Pseudomonas aeruginosa*; non-pathogenic strains of *Bacillus subtilis*; and the like.

In some cases, one or more virulence genes in the bacterium is all or partially deleted. For example, for *Salmonella enterica* serovar *Typhi* and *Salmonella enterica* serovar *Typhimurium*, an aroA, aroC, and aroD mutation can be made. Other mutations that can attenuate pathogenicity affect biosynthesis of the nucleotides adenine (pur) and guanine (guaBA), and outer membrane proteins C and F (ompC, ompF), as well as expression of the cAMP receptor (cya/crp), the conversion of UDP-galactose to UDP-glucose (galE), DNA recombination and repair (recA, recBC), and regulation of virulence genes (phoP, phoQ). For *Listeria monocytogenes*, attenuation can be achieved with auxotrophic mutants, or deletion of virulence factors such as the genes actA and internalin B (intB).

Methods of Inducing an Immune Response to HCV

The present disclosure provides a method of inducing an immune response (e.g., a protective immune response) to at least one HCV genotype in a mammalian subject. In some cases, a method of the present disclosure for inducing an immune response in an individual to at least one HCV genotype comprises administering an immunogenic composition of the present disclosure, where the immunogenic composition comprises polypeptides (e.g., HCV E1/E2; HCV E1; HCV E2; T-cell epitope polypeptide). In some cases, a method of the present disclosure for inducing an immune response in an individual to at least one HCV genotype comprises administering an immunogenic composition of the present disclosure, where the immunogenic composition comprises one or more nucleic acids comprising nucleotide sequences encoding polypeptides (e.g., HCV E1/E2; HCV E1; HCV E2; T-cell epitope polypeptide).

Administering an Immunogenic Composition Comprising Polypeptides

In some cases, the methods comprise administering to an individual in need thereof an effective amount of an immunogenic composition of the present disclosure, where the immunogenic composition comprises: a) an HCV E1/E2 heterodimer; b) a T-cell epitope polypeptide comprising a T-cell epitope present in an HCV polypeptide other than E1 and E2; and c) a pharmaceutically acceptable excipient; or where the immunogenic composition comprises: a) an HCV E2 polypeptide; b) a T-cell epitope polypeptide comprising a T-cell epitope present in an HCV polypeptide other than E1 and E2; and c) a pharmaceutically acceptable excipient; or where the immunogenic composition comprises: a) an HCV E1 polypeptide; b) a T-cell epitope polypeptide comprising a T-cell epitope present in an HCV polypeptide other than E1 and E2; and c) a pharmaceutically acceptable excipient.

Administering an Immunogenic Composition Comprising Nucleic Acid(s)

In some cases, a method of the present disclosure for inducing an immune response to HCV in an individual comprises administering to the individual an effective amount of a nucleic acid(s) comprising nucleotide sequences encoding: 1) an HCV E1/E2 heterodimer and a T-cell epitope polypeptide; 2) an HCV E2 polypeptide and a T-cell epitope polypeptide; or 3) an HCV E1 polypeptide and a T-cell epitope polypeptide. The polypeptides can be encoded in the same nucleic acid, or on separate nucleic acids. For example, where the nucleic acid(s) are recombinant expression vectors, the polypeptides can be encoded in the same or separate recombinant expression vectors.

In some cases, the nucleic acid(s) is/are DNA. In some cases, the nucleic acid(s) is/are RNA. In some cases, the nucleic acid(s) is/are present in expression vector(s) such that a recombinant expression vector(s) comprising the nucleic acid(s) are administered. In some cases, the recombinant expression vector(s) is/are recombinant viral vector (s). In some cases, the recombinant viral vector(s) are packaged into viral particles. In some cases, the nucleic acid(s) are present in bacteria (e.g., non-pathogenic bacteria (e.g., attenuated bacteria) suitable for delivery of nucleic acids to an individual).

In some cases, the nucleic acid is present in an expression vector, thereby generating a recombinant expression vector. Suitable expression vectors include, but are not limited to, a replication-defective adenovirus vector; a replication-defective vaccinia virus vector; a lentivirus vector (e.g., a self-inactivating lentivirus vector); a retroviral vector (e.g., a self-inactivating retroviral vector); an adeno-associated virus vector; and the like. In some cases, the vector is a modified vaccinia Ankara (MVA) vector, or an MVA-based vector (see, e.g., Verheust et al. (2012) *Vaccine* 30:2623). In some cases, the vector is a replication-defective adenovirus vector. In some cases, the vector is a replication-defective adenovirus 6 (Ad6) vector. In some cases, the vector is a replication-defective simian adenovirus vector (e.g., ChAd3). Suitable viral vectors are described in, e.g., Thou et al. (2012) *Invest. Ophthalmol. Vis. Sci.* 53:2804; Swadling et al. (2014) *Sci. Transl. Med.* 6:261ra153; and Choi and Chang (2013) *Clin. Exp. Vaccine Res.* 2:97. In many cases, the recombinant viral vectors are packaged into viral particles; and the viral particles are formulated in an immunogenic composition along with a pharmaceutically acceptable carrier.

In some cases, an HCV E1/E2 heterodimer is encoded by nucleotide sequences present in a first recombinant viral vector, e.g., an adenovirus vector, a vaccinia virus vector, an MVA vector or MVA-based vector; and a T-cell epitope polypeptide is encoded by nucleotide sequences present in a second recombinant viral vector, e.g., an adenovirus vector, a vaccinia virus vector, an MVA vector or MVA-based vector.

In some cases, a prime-boost vaccine protocol is used. In some cases, a first (priming) immunogenic composition is administered, where the first immunogenic composition comprises a recombinant viral vector comprising nucleotide sequences encoding one or more of: a) an HCV E1/E2 heterodimer; b) an HCV E2 polypeptide; c) an HCV E1 polypeptide; and d) a T-cell epitope polypeptide; and, after a time, a second (booster) immunogenic composition is administered, where the second immunogenic composition comprises a recombinant viral vector comprising nucleotide sequences encoding one or more of: a) an HCV E1/E2 heterodimer; b) an HCV E2 polypeptide; c) an HCV E1 polypeptide; and d) a T-cell epitope polypeptide. In some cases, the first recombinant viral vector and the second recombinant viral vector are the same. In some cases, the first recombinant viral vector and the second recombinant viral vector are different. For example, in some cases, the first recombinant viral vector is a vaccinia-based recombinant viral vector; and the second recombinant viral vector is an adenovirus-based recombinant viral vector. In general, the recombinant viral vectors are packaged into viral particles. A second immunogenic composition can be administered at a time period of from 1 day to 1 year following administration of the first immunogenic composition. For example, a second immunogenic composition can be administered at a time period of from 1 day to 1 week, from 1 week to 2 weeks, from 2 weeks to 1 month, from 1 month to 2 months, from 2 months to 6 months, or from 6 months to 1 year following administration of the first immunogenic composition.

For example, in some cases, a first (priming) vaccine comprising a recombinant adenovirus (e.g., Ad6 or chimpanzee Ad (e.g., ChAd3)) that comprises a nucleotide sequence encoding an HCV E1/E2 heterodimer is followed by a second (booster) vaccine comprising a recombinant MVA vector that comprises a nucleotide sequence encoding a T-cell epitope polypeptide. Other prime-boost protocols can be used. For example, multiple primes and/or multiple boosts can be administered.

In some cases, a first (priming) immunogenic composition is administered, where the first immunogenic composition comprises one or more of: a) an HCV E1/E2 heterodimer; b) an HCV E2 polypeptide; c) an HCV E1 polypeptide; and d) a T-cell epitope polypeptide, as described above; and a second (boosting) immunogenic composition is administered, where the second immunogenic composition comprises a recombinant viral vector comprising nucleotide sequence(s) encoding one or more of: a) an HCV E1/E2 heterodimer; b) an HCV E2 polypeptide; c) an HCV E1 polypeptide; and d) a T-cell epitope polypeptide, as described above.

In some cases, a first (priming) immunogenic composition is administered, where the first immunogenic composition comprises a recombinant viral vector comprising nucleotide sequence(s) encoding one or more of: a) an HCV E1/E2 heterodimer; b) an HCV E2 polypeptide; c) an HCV E1 polypeptide; and d) a T-cell epitope polypeptide, as described above; and a second (boosting) immunogenic composition is administered, where the second immunogenic composition comprises one or more of: a) an HCV E1/E2 heterodimer; b) an HCV E2 polypeptide; c) an HCV E1 polypeptide; and d) a T-cell epitope polypeptide, as described above.

In some cases, a co-immunization regimen is carried out, in which a polypeptide(s) per se is administered substantially concomitantly with a nucleic acid(s) encoding the polypeptide(s). For example, in some cases, a method of the present disclosure for inducing an immune response to an HCV polypeptide can comprise administering: a) a first immunogenic composition of the present disclosure, as described above, where the immunogenic composition comprises: i) an HCV E1/E2 heterodimer; ii) a T-cell epitope polypeptide; and iii) a pharmaceutically acceptable carrier; or i) an HCV E1 polypeptide; ii) a T-cell epitope polypeptide; and iii) a pharmaceutically acceptable carrier; or i) an HCV E2 polypeptide; ii) a T-cell epitope polypeptide; and iii) a pharmaceutically acceptable carrier; and b) a second immunogenic composition of the present disclosure, as described above, where the immunogenic composition comprises: i) one or more nucleic acids comprising nucleotide sequence encoding one or more of: an HCV E1/E2 heterodimer, an HCV E1 polypeptide, an HCV E2 polypeptide, and a T-cell epitope polypeptide; and ii) a pharmaceutically acceptable carrier. In some cases, the first and the second immunogenic compositions are in a single formulation. In some cases, the first and the second immunogenic compositions are in separate formulations. In some cases, the first and the second immunogenic compositions are administered via the same route of administration. In some cases, the first and the second immunogenic compositions are administered via different routes of administration. In some cases, the first and the second immunogenic compositions are in separate formulations that are administered substantially simultaneously, e.g., within 1 minute, within 1 minute to 5 minutes, within 5 minutes to 15 minutes, or within 15 minutes to 30 minutes, of one another. In some cases, the first and the second immunogenic compositions are administered multiple times to an individual.

In some cases, a co-immunization regimen is carried out, in which a polypeptide(s) per se is administered substantially concomitantly with a nucleic acid(s) encoding the polypeptide(s). For example, in some cases, a method of the present disclosure for inducing an immune response to an HCV polypeptide can comprise administering: a) a first immunogenic composition of the present disclosure, as described above, where the immunogenic composition comprises: i) an HCV E1/E2 heterodimer; ii) a T-cell epitope polypeptide; and iii) a pharmaceutically acceptable carrier; and b) a second immunogenic composition of the present disclosure, as described above, where the immunogenic composition comprises: i) one or more nucleic acids comprising nucleotide sequences encoding an HCV E1/E2 heterodimer and a T-cell epitope polypeptide; and ii) a pharmaceutically acceptable carrier. In some cases, the first and the second immunogenic compositions are in a single formulation. In some cases, the first and the second immunogenic compositions are in separate formulations. In some cases, the first and the second immunogenic compositions are administered via the same route of administration. In some cases, the first and the second immunogenic compositions are administered via different routes of administration. In some cases, the first and the second immunogenic compositions are in separate formulations that are administered substantially simultaneously, e.g., within 1 minute, within 1 minute to 5 minutes, within 5 minutes to 15 minutes, or within 15 minutes to 30 minutes, of one another. In some cases, the first and the second immunogenic compositions are administered multiple times to an individual. In some cases, the one or more nucleic acids are recombinant viral vectors.

In some cases, a method of the present disclosure for inducing an immune response to HCV in an individual comprises administering to the individual an effective amount of a nucleic acid(s) comprising nucleotide sequences encoding 1) an HCV E1/E2 heterodimer and a T-cell epitope polypeptide; 2) an HCV E2 polypeptide and a T-cell epitope polypeptide; or 3) an HCV E1 polypeptide and a T-cell epitope polypeptide. In some cases, the nucleic acid is an RNA comprising nucleotide sequences encoding a polypeptide of the present disclosure (e.g., an HCV E1/E2 heterodimer; an HCV E1 polypeptide; an HCV E2 polypeptide; a T-cell epitope polypeptide, as described herein. See, e.g., Weiner (2013) *Molec. Therapy* 21:506; and Ulmer et al. (2012) *Vaccine* 30:4414. In some cases, an RNA (e.g., a single mRNA molecule; or 2 mRNA molecules; or 3 mRNA molecules) comprising nucleotide sequences encoding a polypeptide of the present disclosure is formulated with a liposome. In some cases, an RNA (e.g., a single mRNA molecule; or 2 mRNA molecules) comprising nucleotide sequences encoding a polypeptide of the present disclosure is complexed with protamine. In some cases, an RNA (e.g., a single mRNA molecule; or 2 mRNA molecules) comprising nucleotide sequences encoding a polypeptide of the present disclosure is complexed with 1,2-dioleoyl-3-trimethylammonium-propane/1,2-dioleoyl-sn-glycero-3-phosphoethanolamine (DOTAP/DOPE).

In some cases, the nucleic acid(s) are present in bacteria (e.g., non-pathogenic bacteria suitable for delivery of nucleic acids to an individual). In some cases, the nucleic acid(s) are present in recombinant expression vector(s) present in bacteria (e.g., non-pathogenic bacteria suitable for delivery of nucleic acids to an individual). In some cases, the bacteria are live. In some cases, the bacteria are live attenuated bacteria. In some cases, the bacteria are killed. Bacteria suitable for delivery of nucleic acid(s) (which may be present in expression vectors) include, but are not limited to, *Lactobacillus; Lactococcus* (e.g., *Lactococcus* lactic); *Salmonella*, e.g., attenuated, non-pathogenic *Salmonella*, e.g., *Salmonella enterica* serovar *Typhi, Salmonella enterica* serovar *Typhimurium*; non-pathogenic strains of *Escherichia coli*; non-pathogenic strains of *Bordetella pertussis*; non-pathogenic strains of *Listeria*; non-pathogenic strains of *Shigella*; non-pathogenic strains of *Vibrio* (e.g., *Vibrio cholera*); *Streptococcus gordonii*; non-pathogenic strains of *Yersinia enterocolitica*; non-pathogenic strains of *Shigella flexneri*; non-pathogenic strains of *Pseudomonas aeruginosa*; non-pathogenic strains of *Bacillus subtilis*; and the like. In some cases, one or more virulence genes in the bacterium is all or partially deleted. For example, for *Salmonella enterica* serovar *Typhi* and *Salmonella enterica* serovar *Typhimurium*, an aroA, aroC, and aroD mutation can be made. Other mutations that can attenuate pathogenicity affect biosynthesis of the nucleotides adenine (pur) and guanine (guaBA), and outer membrane proteins C and F (ompC, ompF), as well as expression of the cAMP receptor (cya/crp), the conversion of UDP-galactose to UDP-glucose (galE), DNA recombination and repair (recA, recBC), and regulation of virulence genes (phoP, phoQ). For *Listeria monocytogenes*, attenuation can be achieved with auxotrophic mutants, or deletion of virulence factors such as the genes actA and internalin B (intB).

General Considerations

An immunogenic composition of the present disclosure is generally administered to a human subject who has an HCV infection or who is at risk of acquiring an HCV infection (e.g., is at greater risk than the general population of acquiring an HCV infection) so as to prevent or at least partially arrest the development of disease and its complications. An amount adequate to accomplish this is defined as a "therapeutically effective dose" or a "therapeutically effective amount." "Prophylactic" use of a subject immunogenic composition generally refers to administration to an individual who has not been infected with HCV. "Therapeutic" use of a subject immunogenic composition can refer to "prophylactic" use (administration to an individual who has not been infected with HCV) and/or to administration to an individual who has an HCV infection. A "therapeutically effective amount" of an immunogenic composition of the present disclosure, can be an amount that, when administered in one or more doses to an individual who is not infected with HCV, is effective to induce an immune response in the individual to HCV. A "therapeutically effective amount" of an immunogenic composition of the present disclosure, can be an amount that, when administered in one or more doses to an individual who is infected with HCV, is effective to enhance an immune response in the individual to HCV.

Amounts effective for therapeutic use will depend on, e.g., the manner of administration, the weight and general state of health of the patient, and the judgment of the prescribing physician. Single or multiple doses of a subject immunogenic composition can be administered depending on the dosage and frequency required and tolerated by the patient, and route of administration.

In some cases, an effective amount of an immunogenic composition of the present disclosure is an amount that, when administered to an individual in one or more doses, is effective to induce an antibody response (e.g., a neutralizing antibody response) to HCV in the individual. For example, antibody to HCV (e.g., extracellular HCV), and/or to an HCV-infected cell, can be induced.

An effective amount of an immunogenic composition of the present disclosure can be an amount that, when administered to an individual in one or more doses, is effective to induce a neutralizing antibody response to HCV of a variety of genotypes (e.g., genotype 1; genotype 3; etc.). A neutralizing antibody response reduces binding of HCV to one or more host receptors for HCV and inhibits entry of HCV into a cell.

In some cases, an effective amount (e.g., a therapeutically effective amount) of an immunogenic composition of the present disclosure is an amount that, when administered to an individual in one or more doses, is effective to induce a cytotoxic T lymphocyte (CTL) response to HCV. For example, a CTL response to an HCV-infected cell can be induced.

In some cases, an effective amount (e.g., a therapeutically effective amount) of an immunogenic composition of the present disclosure is an amount that, when administered to an individual in one or more doses, is effective to induce a helper T lymphocyte (e.g., $CD4^+$ T cell) to HCV in an individual.

In some cases, an effective amount (e.g., a therapeutically effective amount) of an immunogenic composition of the present disclosure is an amount that, when administered to an individual in one or more doses, is effective to induce an antibody response (e.g., a neutralizing antibody response) and/or a CTL response and/or a helper T cell response to HCV genotype 1. In some cases, an effective amount (e.g., a therapeutically effective amount) of an immunogenic composition of the present disclosure is an amount that, when administered to an individual in one or more doses, is effective to induce an antibody response (e.g., a neutralizing antibody response) and/or a CTL response and/or a helper T cell response to HCV genotype 3. In some cases, an effective amount (e.g., a therapeutically effective amount) of an immunogenic composition of the present disclosure is an amount that, when administered to an individual in one or more doses, is effective to induce an antibody response (e.g., a neutralizing antibody response) and/or a CTL response and/or a helper T cell response to HCV genotype 1 and HCV genotype 3. In some cases, an effective amount (e.g., a therapeutically effective amount) of an immunogenic composition of the present disclosure is an amount that, when administered to an individual in one or more doses, is effective to induce an antibody response (e.g., a neutralizing antibody response) and/or a CTL response and/or a helper T cell response to HCV of any genotype.

An immunogenic composition of the present disclosure is generally administered in an amount effective to elicit an immune response, e.g., a humoral immune response (e.g., an antibody response) and/or a CTL response, in the mammalian subject. Effective amounts for immunization will vary, and can generally range from about 1 μg to 100 jug per 70 kg patient, e.g., from about 5 μg/70 kg to about 50 μg/70 kg. Substantially higher dosages (e.g. 10 mg to 100 mg or more) may be suitable in oral, nasal, or topical administration routes. The initial administration can be followed by booster immunization of the same immunogenic composition or a different immunogenic composition. In some instances, a subject method of inducing an immune response involves an initial administration of an immunogenic composition of the present disclosure, followed by at least one booster, and in some instances involves two or more (e.g., three, four, or five) boosters. The interval between an initial administration and a booster, or between a give booster and a subsequent booster, can be from about 1 week to about 12 weeks, e.g., from about 1 week to about 2 weeks, from about 2 weeks to about 4 weeks, from about 4 weeks to about 6 weeks, from about 6 weeks to about 8 weeks, from about 8 weeks to about 10 weeks, or from about 10 weeks to about 12 weeks. The interval between an initial administration and a booster, or between a give booster and a subsequent booster, can be from 4 months to 6 months, or from 6 months to 1 year.

In general, immunization can be accomplished by administration of an immunogenic composition of the present disclosure by any suitable route, including administration of the composition orally, nasally, nasopharyngeally, parenterally, enterically, gastrically, topically, transdermally, subcutaneously, intramuscularly, in tablet, solid, powdered, liquid, aerosol form, locally or systemically, with or without added excipients. Actual methods for preparing parenterally administrable compositions will be known or apparent to those skilled in the art and are described in more detail in such publications as Remington's Pharmaceutical Science, 15th ed., Mack Publishing Company, Easton, Pa. (1980). In some instances, immunization is accomplished by intramuscular injection of an immunogenic composition of the present disclosure.

Individuals Suitable for Administration

Individuals who are suitable for administration with an immunogenic composition of the present disclosure include immunologically naïve individuals (e.g., individuals who have not been infected with HCV and/or who have not been administered with an HCV vaccine). Individuals suitable for administration include humans.

Individuals who are suitable for administration with an immunogenic composition of the present disclosure composition of the present disclosure include individuals who are at greater risk than the general population of becoming infected with HCV, where such individuals include, e.g., intravenous drug users; individuals who are the recipients, or the prospective recipients, of blood or blood products from another (donor) individual(s); individuals who are the recipients, or the prospective recipients, of non-autologous cells, tissues, or organs from another (donor) individual; health care workers; emergency medical and non-medical personnel (e.g., first responders; fire fighters; emergency medical team personnel; etc.) and the like.

Individuals who are suitable for administration with an immunogenic composition of the present disclosure composition of the present disclosure include individuals who recently became exposed to HCV or who recently became infected with HCV. For example, a subject immunogenic composition can be administered to an individual within from about 24 hours to about 48 hours, from about 48 hours to about 1 week, or from about 1 week to about 4 weeks, following possible or suspected exposure to HCV or following infection with HCV.

Individuals who are suitable for administration with an immunogenic composition of the present disclosure composition of the present disclosure include individuals who have been diagnosed as having an HCV infection, and include chronically infected individuals. In some cases, an individual who has been diagnosed as having an HCV infection is treated with an anti-viral agent and an immunogenic composition of the present disclosure. Suitable anti-viral agents for treating HCV infection include, e.g., ribavirin (1-(3-D-ribofuranosyl-1H-1,2,4-triazole-3-carboxamide); interferon-alpha (IFN-α) (where "IFN-α" includes IFN-α2a; IFN-α2b; IFN-α that is conjugated with poly (ethylene glycol) ("pegylated IFN-α), where the pegylated IFN-α can be pegylated IFN-α2a or pegylated IFN-α 2b); an HCV NS3 protease inhibitor (e.g., boceprevir; telaprevir); and an HCV NS5 protease inhibitor. In some cases, an individual who has been diagnosed as having an HCV infection is treated with, e.g.: 1) IFN-α+ribavirin; and an immunogenic composition of the present disclosure; or 2) IFN-α+ribavirin+an HCV protease inhibitor (e.g., boceprevir or telaprevir); and an immunogenic composition of the present disclosure. Suitable anti-viral agents for treating HCV infection include Sovaldi (Sofosbuvir; a nucleotide analog that functions as an NS5B polymerase inhibitor), alone or in combination with pegylated IFN-α and ribavirin.

Examples of Non-Limiting Aspects of the Disclosure

Aspects, including embodiments, of the present subject matter described above may be beneficial alone or in combination, with one or more other aspects or embodiments. Without limiting the foregoing description, certain non-limiting aspects of the disclosure numbered 1-122 are provided below. As will be apparent to those of skill in the art upon reading this disclosure, each of the individually numbered aspects may be used or combined with any of the preceding or following individually numbered aspects. This is intended to provide support for all such combinations of aspects and is not limited to combinations of aspects explicitly provided below:

Aspect 1. An immunogenic composition comprising: a) a hepatitis C virus (HCV) heterodimeric polypeptide comprising: i) an HCV E1 polypeptide; and ii) an HCV E2 polypeptide; b) a T-cell epitope polypeptide comprising a T-cell epitope present in an HCV protein other than E1 and E2; and c) a pharmaceutically acceptable carrier.

Aspect 2. The immunogenic composition of aspect 1, wherein the T-cell epitope polypeptide comprises one or more T cell epitopes present in one or more of: a) an HCV non-structural polypeptide-3 (NS3) polypeptide; b) an HCV non-structural polypeptide-2 (NS2) polypeptide; c) an HCV non-structural polypeptide-4A (NS4A) polypeptide; d) an HCV non-structural polypeptide-4B (NS4B) polypeptide; e) an HCV non-structural polypeptide-5A (NS5A) polypeptide; f) an HCV non-structural polypeptide-5B (NS5B) polypeptide; g) an HCV core polypeptide; and h) an HCV p7 polypeptide.

Aspect 3. The immunogenic composition of aspect 1 or aspect 2, wherein: a) the HCV E2 polypeptide is derived from an HCV of genotype 1, 2, 3, 4, 5, 6, or 7; and b) the HCV E1 polypeptide is derived from an HCV of genotype 1, 2, 3, 4, 5, 6, or 7.

Aspect 4. The immunogenic composition of aspect 1, wherein the HCV E2 polypeptide comprises an amino acid sequence having at least 20%, at least 25%, at least 30%, at least 35%, at least 40%, at least 45%, at least 50%, at least 60%, at least 70%, at least 80%, at least 90%, at least 95%, at least 98%, at least 99%, or 100%, amino acid sequence identity to an E2 polypeptide depicted in one of FIG. 1A-1C, FIG. 2A-2C, FIG. 3A-3C, and FIG. 4A-4B.

Aspect 5. The immunogenic composition of any one of aspects 1-4, wherein the T-cell epitope polypeptide has a length of from about 10 amino acids to about 3000 amino acids.

Aspect 6. The immunogenic composition of aspects 1-4, wherein the T-cell epitope polypeptide has a length of from about 10 amino acids to about 50 amino acids, from about 100 amino acids to about 230 amino acids, from about 230 amino acids to about 550 amino acids, from about 29 amino acids to about 780 amino acids, from about 100 amino acids to about 780 amino acids, from about 550 amino acids to about 780 amino acids, from about 780 amino acids to 1985 amino acids, or from about 780 amino acids to about 2000 amino acids.

Aspect 7. The immunogenic composition of any one of aspects 1-6, wherein the T-cell epitope polypeptide comprises one or more T cell epitopes present in an HCV NS3 polypeptide.

Aspect 8. The immunogenic composition of aspect 7, wherein the T-cell epitope polypeptide comprises an amino acid sequence having at least 20%, at least 25%, at least 30%, at least 35%, at least 40%, at least 45%, at least 50%, at least 60%, at least 70%, at least 80%, at least 90%, at least 95%, at least 98%, at least 99%, or 100%, amino acid sequence identity to the amino acid sequence of one of TP29, TP50, TP52, TP70, TP100, TP171, TP228, TP553, TP778, and TP1985.

Aspect 9. The immunogenic composition of any one of aspects 1-8, wherein the T-cell epitope polypeptide comprises one or more T cell epitopes present in: a) cholera toxin or toxoid; and/or b) tetanus toxin or toxoid; and/or c) diphtheria toxin or toxoid; and/or d) CRM197.

Aspect 10. The immunogenic composition of any one of aspects 1-8, wherein the composition comprises a polypeptide comprising one or more T cell epitopes present in: a) cholera toxin or toxoid; and/or b) tetanus toxin or toxoid; and/or c) diphtheria toxin or toxoid; and/or d) CRM197.

Aspect 11. The immunogenic composition of any one of aspects 1-10, wherein the E2 polypeptide and/or the E1 polypeptide lacks a C-terminal transmembrane domain.

Aspect 12. The immunogenic composition of any one of aspects 1-11, wherein the HCV E2 polypeptide and the HCV E1 polypeptide are derived from an HCV of the same genotype.

Aspect 13. The immunogenic composition of any one of aspects 1-11, wherein the HCV E2 polypeptide and the HCV E1 polypeptide are derived from an HCV of different genotypes.

Aspect 14. The immunogenic composition of any one of aspects 1-13, wherein the HCV E1 polypeptide comprises an amino acid sequence having at least 20%, at least 25%, at least 30%, at least 35%, at least 40%, at least 45%, at least 50%, at least 60%, at least 70%, at least 80%, at least 90%, at least 95%, at least 98%, at least 99%, or 100%, amino acid sequence identity to an E1 polypeptide depicted in FIG. 1A-1C, FIG. 2A-2C, FIG. 3A-3C, and FIG. 4A-4B.

Aspect 15. The immunogenic composition of aspect 1, wherein the HCV E1/E2 heterodimeric polypeptide comprises:

a) an HCV E1 polypeptide; and b) a modified E2 polypeptide comprising, in order from N-terminus to C-terminus: i) from 1 to 6 heterologous amino acids, wherein the from 1 to 6 heterologous amino acids are C-terminal to a site of proteolytic cleavage in a proteolytically cleavable linker; and ii) an HCV E2 polypeptide; or a) an HCV E2 polypeptide; and b) a modified E1 polypeptide comprising, in order from N-terminus to C-terminus: i) from 1 to 6 heterologous amino acids, wherein the from 1 to 6 heterologous amino acids are C-terminal to a site of proteolytic cleavage in a proteolytically cleavable linker; and ii) an HCV E1 polypeptide; or a) an HCV E1 polypeptide; and b) a modified E2 polypeptide comprising, in order from N-terminus to C-terminus: i) an HCV E2 polypeptide; and ii) from 1 to 6 heterologous amino acids, wherein the from 1 to 6 heterologous amino acids are N-terminal to a site of proteolytic cleavage in a proteolytically cleavable linker; or a) an HCV E2 polypeptide; and b) a modified E1 polypeptide comprising, in order from N-terminus to C-terminus: i) an HCV E1 polypeptide; and ii) from 1 to 6 heterologous amino acids, wherein the from 1 to 6 heterologous amino acids are N-terminal to a site of proteolytic cleavage in a proteolytically cleavable linker.

Aspect 16. The immunogenic composition of aspect 15, wherein: a) the from 1 to 6 heterologous amino acids at the N-terminus of the modified E2 polypeptide or the modified E1 polypeptide are Gly-Pro, Ser, Gly, or Gly-Ser; or b) the from 1 to 6 heterologous amino acids at the C-terminus of the modified E2 polypeptide or the modified E1 polypeptide are LEVLFQ (SEQ ID NO:76), ENLYYFQ (SEQ ID NO:83), LVPR (SEQ ID NO:78), I(E/D)GR (SEQ ID NO:90), or DDDDK (SEQ ID NO:77).

Aspect 17. The immunogenic composition of any one of aspects 1-16, comprising an adjuvant.

Aspect 18. The immunogenic composition of aspect 17, wherein the adjuvant comprises MF59; alum; poly(DL-lactide co-glycolide); a CpG oligonucleotide; keyhole limpet hemocyanin; a suspension of liposomes comprising 3'-O-desacyl-4'-monophosphoryl lipid A (MPL) and *Quillaja saponaria* 21 (QS21); AS01; or alum+MPL.

Aspect 19. The immunogenic composition of any one of aspects 1-18, wherein the T-cell epitope polypeptide comprises an amino acid sequence having at least 20%, at least 25%, at least 30%, at least 35%, at least 40%, at least 45%, at least 50%, at least 60%, at least 70%, at least 80%, at least 90%, at least 95%, at least 98%, at least 99%, or 100%, amino acid sequence identity to a polypeptide depicted in any one of FIGS. 9A, 9B, 10A-10D, and 11A-11N.

Aspect 20. A method of inducing an immune response in an individual to a hepatitis C virus (HCV) polypeptide, the method comprising administering to the individual an effective amount of the immunogenic composition of any one of aspects 1-19.

Aspect 21. The method of aspect 20, wherein said administering is by intramuscular administration.

Aspect 22. The method of aspect 20, wherein said administering is by subcutaneous administration.

Aspect 23. An immunogenic composition comprising: a) a hepatitis C virus (HCV) T-cell epitope polypeptide comprising a T-cell epitope present in an HCV protein other than E1 and E2; and b) a pharmaceutically acceptable excipient.

Aspect 24. The immunogenic composition of aspect 23, wherein the HCV T-cell epitope polypeptide comprises one or more T cell epitopes present in one or more of:

a) an HCV non-structural polypeptide-3 (NS3) polypeptide;

b) an HCV non-structural polypeptide-2 (NS2) polypeptide;

c) an HCV non-structural polypeptide-4A (NS4A) polypeptide;

d) an HCV non-structural polypeptide-4B (NS4B) polypeptide;

e) an HCV non-structural polypeptide-5A (NS5A) polypeptide;

an HCV non-structural polypeptide-5B (NS5B) polypeptide;

g) an HCV core polypeptide; and h) an HCV p7 polypeptide.

Aspect 25. The immunogenic composition of aspect 23, wherein the HCV T-cell epitope polypeptide has a length of from about 10 amino acids to about 50 amino acids, from about 100 amino acids to about 230 amino acids, from about 230 amino acids to about 550 amino acids, from about 29 amino acids to about 780 amino acids, from about 100 amino acids to about 780 amino acids, from about 550 amino acids to about 780 amino acids, from about 780 amino acids to 1985 amino acids, or from about 780 amino acids to about 2000 amino acids.

Aspect 26. The immunogenic composition of any one of aspects 23-25, wherein the HCV T-cell epitope polypeptide comprises one or more T cell epitopes present in an HCV NS3 polypeptide.

Aspect 27. The immunogenic composition any one of aspects 23-26, wherein the HCV T-cell epitope polypeptide comprises an amino acid sequence having at least 20%, at least 25%, at least 30%, at least 35%, at least 40%, at least 45%, at least 50%, at least 60%, at least 70%, at least 80%, at least 90%, at least 95%, at least 98%, at least 99%, or 100%, amino acid sequence identity to the amino acid sequence of one of TP29, TP50, TP52, TP70, TP100, TP171, TP228, TP553, TP778, and TP1985.

Aspect 28. The immunogenic composition of any one of aspects 23-27, wherein the HCV T-cell epitope polypeptide comprises one or more T cell epitopes present in:

a) cholera toxin or toxoid; and/or b) tetanus toxin or toxoid; and/or c) diphtheria toxin or toxoid; and/or d) CRM197.

Aspect 29. The immunogenic composition of any one of aspects 23-27, wherein the composition comprises a polypeptide comprising one or more T cell epitopes present in:

a) cholera toxin or toxoid; and/or b) tetanus toxin or toxoid; and/or c) diphtheria toxin or toxoid; and/or d) CRM197.

Aspect 30. The immunogenic composition of any one of aspects 23-29, comprising an adjuvant.

Aspect 31. The immunogenic composition of aspect 30, wherein the adjuvant comprises MF59; alum; poly(DL-lactide co-glycolide); a CpG oligonucleotide; keyhole limpet hemocyanin; a suspension of liposomes comprising 3'-O-desacyl-4'-monophosphoryl lipid A (MPL) and *Quillaja saponaria* 21 (QS21); AS01; or alum+MPL.

Aspect 32. The immunogenic composition of any one of aspects 23-31, wherein the HCV T-cell polypeptide comprises an amino acid sequence having at least 20%, at least 25%, at least 30%, at least 35%, at least 40%, at least 45%, at least 50%, at least 60%, at least 70%, at least 80%, at least 90%, at least 95%, at least 98%, at least 99%, or 100%, amino acid sequence identity to a polypeptide depicted in any one of FIGS. 9A, 9B, 10A-10D, and 11A-11N.

Aspect 33. The immunogenic composition of any one of aspects 23-32, comprising two or more different HCV T-cell epitope polypeptides.

Aspect 34. A method of inducing an immune response in an individual, the method comprising administering to the individual an effective amount of the immunogenic composition of any one of aspects 23-33.

Aspect 35. The method of aspect 34, wherein said administering comprises subcutaneous administration or intramuscular administration.

Aspect 36. An immunogenic composition comprising: a) a hepatitis C virus (HCV) E2 polypeptide; b) a T-cell epitope polypeptide comprising a T-cell epitope present in an HCV protein other than E1 and E2; and c) a pharmaceutically acceptable carrier.

Aspect 37. The immunogenic composition of aspect 36, wherein the T-cell epitope polypeptide comprises one or more T cell epitopes present in one or more of:

a) an HCV non-structural polypeptide-3 (NS3) polypeptide;

b) an HCV non-structural polypeptide-2 (NS2) polypeptide;

c) an HCV non-structural polypeptide-4A (NS4A) polypeptide;

d) an HCV non-structural polypeptide-4B (NS4B) polypeptide;

e) an HCV non-structural polypeptide-5A (NS5A) polypeptide;

f) an HCV non-structural polypeptide-5B (NS5B) polypeptide;

g) an HCV core polypeptide; and h) an HCV p7 polypeptide.

Aspect 38. The immunogenic composition of aspect 36 or aspect 37, wherein the HCV E2 polypeptide is derived from an HCV of genotype 1, 2, 3, 4, 5, 6, or 7.

Aspect 39. The immunogenic composition of aspect 36, wherein the HCV E2 polypeptide comprises an amino acid sequence having at least 20%, at least 25%, at least 30%, at least 35%, at least 40%, at least 45%, at least 50%, at least 60%, at least 70%, at least 80%, at least 90%, at least 95%, at least 98%, at least 99%, or 100%, amino acid sequence identity to an E2 polypeptide depicted in one of FIG. 1A-1C, FIG. 2A-2C, FIG. 3A-3C, and FIG. 4A-4B.

Aspect 40. The immunogenic composition of any one of aspects 1-4, wherein the T-cell epitope polypeptide has a length of from about 10 amino acids to about 3000 amino acids.

Aspect 41. The immunogenic composition of aspects 36-40, wherein the T-cell epitope polypeptide has a length of from about 10 amino acids to about 50 amino acids, from about 100 amino acids to about 230 amino acids, from about 230 amino acids to about 550 amino acids, from about 29 amino acids to about 780 amino acids, from about 100 amino acids to about 780 amino acids, from about 550 amino acids to about 780 amino acids, from about 780 amino acids to 1985 amino acids, or from about 780 amino acids to about 2000 amino acids.

Aspect 42. The immunogenic composition of any one of aspects 36-41, wherein the T-cell epitope polypeptide comprises one or more T cell epitopes present in an HCV NS3 polypeptide.

Aspect 43. The immunogenic composition of aspect 42, wherein the T-cell epitope polypeptide comprises an amino acid sequence having at least 20%, at least 25%, at least 30%, at least 35%, at least 40%, at least 45%, at least 50%, at least 60%, at least 70%, at least 80%, at least 90%, at least 95%, at least 98%, at least 99%, or 100%, amino acid sequence identity to the amino acid sequence of one of TP29, TP50, TP52, TP70, TP100, TP171, TP228, TP553, TP778, and TP1985.

Aspect 44. The immunogenic composition of any one of aspects 36-43, wherein the T-cell epitope polypeptide comprises one or more T cell epitopes present in:

a) cholera toxin or toxoid; and/or b) tetanus toxin or toxoid; and/or c) diphtheria toxin or toxoid; and/or d) CRM197.

Aspect 45. The immunogenic composition of any one of aspects 36-43, wherein the composition comprises a polypeptide comprising one or more T cell epitopes present in: a) cholera toxin or toxoid; and/or b) tetanus toxin or toxoid; and/or c) diphtheria toxin or toxoid; and/or d) CRM197.

Aspect 46. The immunogenic composition of any one of aspects 36-45, wherein the E2 polypeptide lacks a C-terminal transmembrane domain.

Aspect 47. The immunogenic composition of any one of aspects 36-46, wherein the HCV E2 polypeptide is:

a) a modified E2 polypeptide comprising, in order from N-terminus to C-terminus: i) from 1 to 6 heterologous amino acids, wherein the from 1 to 6 heterologous amino acids are C-terminal to a site of proteolytic cleavage in a proteolytically cleavable linker; and ii) an HCV E2 polypeptide; or b) a modified E2 polypeptide comprising, in order from N-terminus to C-terminus: i) an HCV E2 polypeptide; and ii) from 1 to 6 heterologous amino acids, wherein the from 1 to 6 heterologous amino acids are N-terminal to a site of proteolytic cleavage in a proteolytically cleavable linker.

Aspect 48. The immunogenic composition of aspect 47, wherein: a) the from 1 to 6 heterologous amino acids at the N-terminus of the modified E1 polypeptide are Gly-Pro, Ser, Gly, or Gly-Ser; or b) the from 1 to 6 heterologous amino acids at the C-terminus of the modified E1 polypeptide are LEVLFQ (SEQ ID NO:76), ENLYYFQ (SEQ ID NO:83), LVPR (SEQ ID NO:78), I(E/D)GR (SEQ ID NO:90), or DDDDK (SEQ ID NO:77).

Aspect 49. The immunogenic composition of any one of aspects 36-48, comprising an adjuvant.

Aspect 50. The immunogenic composition of aspect 49, wherein the adjuvant comprises MF59; alum; poly(DL-lactide co-glycolide); a CpG oligonucleotide; keyhole limpet hemocyanin; a suspension of liposomes comprising 3'-O-desacyl-4'-monophosphoryl lipid A (MPL) and *Quillaja saponaria* 21 (QS21); AS01; or a combination of alum and MPL.

Aspect 51. The immunogenic composition of any one of aspects 36-50, wherein the T-cell epitope polypeptide comprises an amino acid sequence having at least 20%, at least 25%, at least 30%, at least 35%, at least 40%, at least 45%, at least 50%, at least 60%, at least 70%, at least 80%, at least 90%, at least 95%, at least 98%, at least 99%, or 100%, amino acid sequence identity to a polypeptide depicted in any one of FIGS. 9A, 9B, 10A-10D, and 11A-11N.

Aspect 52. A method of inducing an immune response in an individual to a hepatitis C virus (HCV) polypeptide, the method comprising administering to the individual an effective amount of the immunogenic composition of any one of aspects 36-51.

Aspect 53. The method of aspect 52, wherein said administering is by intramuscular administration.

Aspect 54. The method of aspect 52, wherein said administering is by subcutaneous administration.

Aspect 55. An immunogenic composition comprising: a) a hepatitis C virus (HCV) E1 polypeptide; b) a T-cell epitope polypeptide comprising a T-cell epitope present in an HCV protein other than E1 and E2; and c) a pharmaceutically acceptable carrier.

Aspect 56. The immunogenic composition of aspect 55, wherein the T-cell epitope polypeptide comprises one or more T cell epitopes present in one or more of:

a) an HCV non-structural polypeptide-3 (NS3) polypeptide;

b) an HCV non-structural polypeptide-2 (NS2) polypeptide;

c) an HCV non-structural polypeptide-4A (NS4A) polypeptide;

d) an HCV non-structural polypeptide-4B (NS4B) polypeptide;

e) an HCV non-structural polypeptide-5A (NS5A) polypeptide;

an HCV non-structural polypeptide-5B (NS5B) polypeptide;

g) an HCV core polypeptide; and h) an HCV p7 polypeptide.

Aspect 57. The immunogenic composition of aspect 55 or aspect 56, wherein the HCV E1 polypeptide is derived from an HCV of genotype 1, 2, 3, 4, 5, 6, or 7.

Aspect 58. The immunogenic composition of aspect 55, wherein the HCV E1 polypeptide comprises an amino acid sequence having at least 20%, at least 25%, at least 30%, at least 35%, at least 40%, at least 45%, at least 50%, at least 60%, at least 70%, at least 80%, at least 90%, at least 95%, at least 98%, at least 99%, or 100%, amino acid sequence identity to an E1 polypeptide depicted in one of FIG. 1A-1C, FIG. 2A-2C, FIG. 3A-3C, and FIG. 4A-4B.

Aspect 59. The immunogenic composition of any one of aspects 55-58, wherein the T-cell epitope polypeptide has a length of from about 10 amino acids to about 3000 amino acids.

Aspect 60. The immunogenic composition of any one of aspects 55-58, wherein the T-cell epitope polypeptide has a length of from about 10 amino acids to about 50 amino acids, from about 100 amino acids to about 230 amino acids, from about 230 amino acids to about 550 amino acids, from about 29 amino acids to about 780 amino acids, from about 100 amino acids to about 780 amino acids, from about 550 amino acids to about 780 amino acids, from about 780 amino acids to 1985 amino acids, or from about 780 amino acids to about 2000 amino acids.

Aspect 61. The immunogenic composition of any one of aspects 55-60, wherein the T-cell epitope polypeptide comprises one or more T cell epitopes present in an HCV NS3 polypeptide.

Aspect 62. The immunogenic composition of any one of aspects 55-60, wherein the T-cell epitope polypeptide comprises an amino acid sequence having at least 20%, at least 25%, at least 30%, at least 35%, at least 40%, at least 45%, at least 50%, at least 60%, at least 70%, at least 80%, at least 90%, at least 95%, at least 98%, at least 99%, or 100%, amino acid sequence identity to the amino acid sequence of one of TP29, TP50, TP52, TP70, TP100, TP171, TP228, TP553, TP778, and TP1985.

Aspect 63. The immunogenic composition of any one of aspects 55-62, wherein the T-cell epitope polypeptide comprises one or more T cell epitopes present in: a) cholera toxin or toxoid; and/or b) tetanus toxin or toxoid; and/or c) diphtheria toxin or toxoid; and/or d) CRM197.

Aspect 64. The immunogenic composition of any one of aspects 55-62, wherein the composition comprises a polypeptide comprising one or more T cell epitopes present in: a) cholera toxin or toxoid; and/or b) tetanus toxin or toxoid; and/or c) diphtheria toxin or toxoid; and/or d) CRM197.

Aspect 65. The immunogenic composition of any one of aspects 55-64, wherein the E1 polypeptide lacks a C-terminal transmembrane domain.

Aspect 66. The immunogenic composition of any one of aspects 55-64, wherein the HCV E1 polypeptide is:

a) a modified E1 polypeptide comprising, in order from N-terminus to C-terminus: i) from 1 to 6 heterologous amino acids, wherein the from 1 to 6 heterologous amino acids are C-terminal to a site of proteolytic cleavage in a proteolytically cleavable linker; and ii) an HCV E1 polypeptide; or b) a modified E1 polypeptide comprising, in order from N-terminus to C-terminus: i) an HCV E1 polypeptide; and ii) from 1 to 6 heterologous amino acids, wherein the from 1 to 6 heterologous amino acids are N-terminal to a site of proteolytic cleavage in a proteolytically cleavable linker.

Aspect 67. The immunogenic composition of aspect 66, wherein: a) the from 1 to 6 heterologous amino acids at the N-terminus of the modified E1 polypeptide are Gly-Pro, Ser, Gly, or Gly-Ser; or b) the from 1 to 6 heterologous amino acids at the C-terminus of the modified E1 polypeptide are LEVLFQ (SEQ ID NO:76), ENLYYFQ (SEQ ID NO:83), LVPR (SEQ ID NO:78), I(E/D)GR (SEQ ID NO:90), or DDDDK (SEQ ID NO:77).

Aspect 68. The immunogenic composition of any one of aspects 65-67, comprising an adjuvant.

Aspect 69. The immunogenic composition of aspect 68, wherein the adjuvant comprises MF59; alum; poly(DL-lactide co-glycolide); a CpG oligonucleotide; keyhole limpet hemocyanin; a suspension of liposomes comprising 3'-O-desacyl-4'-monophosphoryl lipid A (MPL) and *Quillaja saponaria* 21 (QS21); AS01; or a combination of alum and MPL.

Aspect 70. The immunogenic composition of any one of aspects 55-69, wherein the T-cell epitope polypeptide comprises an amino acid sequence having at least 20%, at least 25%, at least 30%, at least 35%, at least 40%, at least 45%, at least 50%, at least 60%, at least 70%, at least 80%, at least 90%, at least 95%, at least 98%, at least 99%, or 100%, amino acid sequence identity to a polypeptide depicted in any one of FIGS. 9A, 9B, 10A-10D, and 11A-11N.

Aspect 71. A method of inducing an immune response in an individual to a hepatitis C virus (HCV) polypeptide, the method comprising administering to the individual an effective amount of the immunogenic composition of any one of aspects 55-70.

Aspect 72. The method of aspect 71, wherein said administering is by intramuscular administration.

Aspect 73. The method of aspect 71, wherein said administering is by subcutaneous administration.

Aspect 74. An immunogenic composition comprising:

a) a hepatitis C virus (HCV) heterodimeric polypeptide comprising:

i) an HCV E1 polypeptide; and ii) a modified HCV E2 polypeptide comprising a heterologous Gly-Pro, Gly-Ser, Gly, or Ser appended to the N-terminus of an HCV E2 polypeptide;

b) a T-cell epitope polypeptide comprising an amino acid sequence having at least 95% amino acid sequence identity to TP29 and having a length of 29 amino acids; and c) a pharmaceutically acceptable carrier.

Aspect 75. An immunogenic composition comprising:

a) a hepatitis C virus (HCV) heterodimeric polypeptide comprising:

i) an HCV E1 polypeptide; and ii) a modified HCV E2 polypeptide comprising a heterologous Gly-Pro, Gly-Ser, Gly, or Ser appended to the N-terminus of an HCV E2 polypeptide;

b) a T-cell epitope polypeptide comprising an amino acid sequence having at least 95% amino acid sequence identity to TP50 and having a length of 50 amino acids; and c) a pharmaceutically acceptable carrier.

Aspect 76. An immunogenic composition comprising:

a) a hepatitis C virus (HCV) heterodimeric polypeptide comprising:

i) an HCV E1 polypeptide; and ii) a modified HCV E2 polypeptide comprising a heterologous Gly-Pro, Gly-Ser, Gly, or Ser appended to the N-terminus of an HCV E2 polypeptide;

b) a T-cell epitope polypeptide comprising an amino acid sequence having at least 95% amino acid sequence identity to TP52 and having a length of 52 amino acids; and c) a pharmaceutically acceptable carrier.

Aspect 77. An immunogenic composition comprising:

a) a hepatitis C virus (HCV) heterodimeric polypeptide comprising:

i) an HCV E1 polypeptide; and ii) a modified HCV E2 polypeptide comprising a heterologous Gly-Pro, Gly-Ser, Gly, or Ser appended to the N-terminus of an HCV E2 polypeptide;

b) a T-cell epitope polypeptide comprising an amino acid sequence having at least 95% amino acid sequence identity to TP70 and having a length of 70 amino acids; and c) a pharmaceutically acceptable carrier.

Aspect 78. An immunogenic composition comprising:

a) a hepatitis C virus (HCV) heterodimeric polypeptide comprising:

i) an HCV E1 polypeptide; and ii) a modified HCV E2 polypeptide comprising a heterologous Gly-Pro, Gly-Ser, Gly, or Ser appended to the N-terminus of an HCV E2 polypeptide;

b) a T-cell epitope polypeptide comprising an amino acid sequence having at least 95% amino acid sequence identity to TP100 and having a length of 100 amino acids; and c) a pharmaceutically acceptable carrier.

Aspect 79. An immunogenic composition comprising:

a) a hepatitis C virus (HCV) heterodimeric polypeptide comprising:

i) an HCV E1 polypeptide; and ii) a modified HCV E2 polypeptide comprising a heterologous Gly-Pro, Gly-Ser, Gly, or Ser appended to the N-terminus of an HCV E2 polypeptide;

b) a T-cell epitope polypeptide comprising an amino acid sequence having at least 95% amino acid sequence identity to TP171 and having a length of 171 amino acids; and c) a pharmaceutically acceptable carrier.

Aspect 80. An immunogenic composition comprising:

a) a hepatitis C virus (HCV) heterodimeric polypeptide comprising:

i) an HCV E1 polypeptide; and ii) a modified HCV E2 polypeptide comprising a heterologous Gly-Pro, Gly-Ser, Gly, or Ser appended to the N-terminus of an HCV E2 polypeptide;

b) a T-cell epitope polypeptide comprising an amino acid sequence having at least 95% amino acid sequence identity to TP228 and having a length of 228 amino acids; and c) a pharmaceutically acceptable carrier.

Aspect 81. An immunogenic composition comprising:

a) a hepatitis C virus (HCV) heterodimeric polypeptide comprising:

i) an HCV E1 polypeptide; and ii) a modified HCV E2 polypeptide comprising a heterologous Gly-Pro, Gly-Ser, Gly, or Ser appended to the N-terminus of an HCV E2 polypeptide;

b) a T-cell epitope polypeptide comprising an amino acid sequence having at least 95% amino acid sequence identity to TP553 and having a length of 553 amino acids; and c) a pharmaceutically acceptable carrier.

Aspect 82. An immunogenic composition comprising:

a) a hepatitis C virus (HCV) heterodimeric polypeptide comprising:

i) an HCV E1 polypeptide; and ii) a modified HCV E2 polypeptide comprising a heterologous Gly-Pro, Gly-Ser, Gly, or Ser appended to the N-terminus of an HCV E2 polypeptide;

b) a T-cell epitope polypeptide comprising an amino acid sequence having at least 95% amino acid sequence identity to TP778 and having a length of 778 amino acids; and c) a pharmaceutically acceptable carrier.

Aspect 83. An immunogenic composition comprising:

a) a hepatitis C virus (HCV) heterodimeric polypeptide comprising:

i) an HCV E1 polypeptide; and ii) a modified HCV E2 polypeptide comprising a heterologous Gly-Pro, Gly-Ser, Gly, or Ser appended to the N-terminus of an HCV E2 polypeptide;

b) a T-cell epitope polypeptide comprising an amino acid sequence having at least 95% amino acid sequence identity to TP1985 and having a length of 1985 amino acids; and c) a pharmaceutically acceptable carrier.

Aspect 84. The immunogenic composition of any one of aspects 74-83, comprising an adjuvant.

Aspect 85. The immunogenic composition of aspect 83, wherein the adjuvant comprises MF59; alum; poly(DL-lactide co-glycolide); a CpG oligonucleotide; keyhole limpet hemocyanin; a suspension of liposomes comprising 3'-O-desacyl-4'-monophosphoryl lipid A (MPL) and *Quillaja saponaria* 21 (QS21); AS01; or a combination of alum and MPL.

Aspect 86. The immunogenic composition of any one of aspects 74-83, wherein the HCV E1 and E2 polypeptides are a mixture of HCV genotype 1 and HCV genotype 3.

Aspect 87. The immunogenic composition of any one of aspects 74-83, wherein the HCV E1 and E2 polypeptides are a mixture of HCV genotype 1, HCV genotype 2, and HCV genotype 3.

Aspect 88. A method of inducing an immune response to HCV in an individual, the method comprising administering to the individual an effective amount of a nucleic acid immunogenic composition comprising: a) one or more nucleic acids comprising nucleotide sequences encoding one or more of: i) an HCV E1/E2 heterodimer; ii) an HCV E1 polypeptide; iii) an HCV E2 polypeptide; and iv) a T-cell epitope polypeptide comprising a T-cell epitope present in an HCV protein other than E1 and E2; and b) a pharmaceutically acceptable carrier.

Aspect 89. The method of aspect 88, wherein the one or more nucleic acids are recombinant expression vectors.

Aspect 90. The method of aspect 89, wherein the one or more recombinant expression vectors are recombinant viral vectors.

Aspect 91. The method of aspect 90, wherein the one or more recombinant viral vectors are packaged into viral particles.

Aspect 92. The method of aspect 88, wherein the one or more nucleic acids are present within non-pathogenic bacteria.

Aspect 93. The method of aspect 89, comprising administering: a) a first recombinant expression vector comprising nucleotide sequences encoding the HCV E1/E2 heterodimer, and HCV E1 polypeptide, or an HCV E2 polypeptide; and b) a second recombinant expression vector comprising nucleotide sequences encoding the T-cell epitope polypeptide.

Aspect 94. The method of aspect 89, comprising administering: a) a first recombinant expression vector comprising nucleotide sequences encoding the HCV E1/E2 heterodimer; and b) a second recombinant expression vector comprising nucleotide sequences encoding the T-cell epitope polypeptide.

Aspect 95. The method of aspect 94, wherein the first recombinant expression vector and the second recombinant expression vector are two different recombinant virus-based vectors.

Aspect 96. The method of aspect 89, wherein said recombinant expression vector is a recombinant modified vaccinia Ankara vector.

Aspect 97. The method of aspect 89, wherein said recombinant expression vector is a recombinant replication-defective adenovirus.

Aspect 98. The method of aspect 88, comprising administering a polypeptide immunogenic composition, wherein the second immunogenic composition comprises:

a) a hepatitis C virus (HCV) E1/E2 heterodimeric polypeptide comprising:

i) an HCV E1 polypeptide; and ii) an HCV E2 polypeptide;

b) a T-cell epitope polypeptide comprising a T-cell epitope present in an HCV protein other than E1 and E2; and c) a pharmaceutically acceptable carrier.

Aspect 99. The method of aspect 98, wherein the nucleic acid immunogenic composition and the polypeptide immunogenic composition are administered substantially simultaneously.

Aspect 100. The method of aspect 98, wherein the nucleic acid immunogenic composition is administered as a prime administration, and the polypeptide immunogenic composition is administered as a boost administration.

Aspect 101. The method of aspect 98, wherein the polypeptide immunogenic composition is administered as a prime administration, and the nucleic acid immunogenic composition is administered as a boost administration.

Aspect 102. The method of any one of aspects 88-101, wherein said administering is by intramuscular administration.

Aspect 103. The method of any one of aspects 88-101, wherein said administering is by subcutaneous administration.

Aspect 104. An immunogenic composition comprising:

a) one or more nucleic acids comprising nucleotide sequences encoding one or more of: i) an HCV E1/E2 heterodimer; ii) an HCV E1 polypeptide; iii) an HCV E2 polypeptide; and iv) a T-cell epitope polypeptide comprising a T-cell epitope present in an HCV protein other than E1 and E2; and b) a pharmaceutically acceptable carrier.

Aspect 105. The immunogenic composition of aspect 104, wherein the one or more nucleic acids are recombinant expression vectors.

Aspect 106. The immunogenic composition of aspect 105, wherein the one or more recombinant expression vectors are recombinant viral vectors.

Aspect 107. The immunogenic composition of aspect 106, wherein the one or more recombinant viral vectors are packaged into viral particles.

Aspect 108. The immunogenic composition of aspect 104, wherein the one or more nucleic acids are present within non-pathogenic bacteria.

Aspect 109. The immunogenic composition of aspect 104, wherein the one or more nucleic acids are DNA.

Aspect 110. The immunogenic composition of aspect 104, wherein the one or more nucleic acids are RNA.

Aspect 111. An immunogenic composition comprising:

a) one or more nucleic acids comprising nucleotide sequences encoding one or more the polypeptides present in an immunogenic composition of any one of aspects 1-19, aspects 23-33, aspects 36-51, aspects 55-70, or aspects 74-83; and b) a pharmaceutically acceptable carrier.

Aspect 112. The immunogenic composition of aspect 111, wherein the one or more nucleic acids are recombinant expression vectors.

Aspect 113. The immunogenic composition of aspect 112, wherein the one or more recombinant expression vectors are recombinant viral vectors.

Aspect 114. The immunogenic composition of aspect 113, wherein the one or more recombinant viral vectors are packaged into viral particles.

Aspect 115. The immunogenic composition of aspect 111, wherein the one or more nucleic acids are present within non-pathogenic bacteria.

Aspect 116. The immunogenic composition of aspect 111, wherein the one or more nucleic acids are DNA.

Aspect 117. The immunogenic composition of aspect 111, wherein the one or more nucleic acids are RNA.

Aspect 118. A method of inducing an immune response to HCV in an individual, the method comprising administering to the individual an effective amount of an immunogenic composition of any one of aspects 111-117.

Aspect 119. The method of aspect 118, wherein the one or more nucleic acids are present in one or more recombinant viral expression vectors.

Aspect 120. The method of aspect 119, wherein the one or more recombinant expression vectors comprise a recombinant modified vaccinia Ankara vector.

Aspect 121. The method of aspect 119, wherein the one or more recombinant expression vectors comprise a recombinant replication-defective adenovirus.

Aspect 122. The method of aspect 118, wherein the one or more nucleic acids comprise a first recombinant expression vector and a second recombinant expression vector, wherein first recombinant expression vector and the second recombinant expression vector are two different recombinant virus-based vectors.

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

SEQUENCE LISTING (180 sequences)

SEQ ID NO: 1 - protein, 746 aa, Hepatitis C virus
  misc_feature (248)..(248): Xaa can be any naturally occurring amino acid
  misc_feature (262)..(262): Xaa can be any naturally occurring amino acid
  misc_feature (270)..(270): Xaa can be any naturally occurring amino acid
  misc_feature (275)..(275): Xaa can be any naturally occurring amino acid
  misc_feature (399)..(399): Xaa can be any naturally occurring amino acid
  misc_feature (408)..(408): Xaa can be any naturally occurring amino acid
  misc_feature (524)..(524): Xaa can be any naturally occurring amino acid
  misc_feature (580)..(580): Xaa can be any naturally occurring amino acid
  misc_feature (641)..(641): Xaa can be any naturally occurring amino acid
  misc_feature (709)..(709): Xaa can be any naturally occurring amino acid
  misc_feature (733)..(733): Xaa can be any naturally occurring amino acid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETADTILHSPGCVPCVREGNASRCWVALTPTVAXRDGSLPTTQLRRHXDLLVGSAXLCSAXYVGDLCGSVFLVGQLFTFSPRRHWTTQDCNCSIYPGHITGHRMAWDMMMNWSPTTALVVAQLLRIPQAILDMIAGAHWGVLAGIAYFSMVGNWAKVLVVLLLFAGVDAETHVTGGSAARATSGXASLFSPGAXQNIQLINTNGSWHINRTALNCNDSLDTGWVAGLFYYHKFNSSGCPERMASCRPLADFDQGWGPISYANGSGPDQRPYCWHYPPKPCGIVPAQQVCGPVYCFTPSPVVVGTTDRLGXPTYNWGENETDVLVLNNTRPPLGNWFGCTWMNSTGFTKVCGAPPCNIGGVGNNTLXCPTDCFRKHPEATYSRCGSGPWLTPRCLVDYPYRLWHYPCTVNYTIFKVRMYVGGVEHRLXAACNWTRGERCDLDDRDRSELSPLLLSTTQWQVLPCSFTTLPALSTGLIHLHQNIVDVQYLYGVGSSXVSWAIKWEYVILLFLLLADARICXCLWMMLLISQAEA

SEQ ID NO: 2 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGLYHVTNDCPNSSIVYEAADAILHTPGCVPCVREGNTSRCWVAMTPTVATRDGKLPTTQLRRHIDLLVGSATLCSALYVGDLCGSIFLVGQMFTFSPRRHWTTQDCNCSLYPGHITGHRMAWDMMMNWSPTAALITAQLLRIPQAILDMIAGAHWGVLAGIAYFSMVGNWAKVLVVLLLFAGVDAQTHVTGGRAAHITAGLTSLFSPGPSQKLQLVNTNGSWHINSTALNCNDSLKTGWIAGLLYSYKFNSSGCPERLASCRRLTDFAQGWGPISHANGSGPDERPYCWHYPPRPCGIVPAKSVCGPVYCFTPSPVVVGTTDKSGAPTYNWGENDTDVFVLNNTRPPLGNWFGCTWMNSTGFTKVCGAPPCVIGGAGNNTLRCPTDCFRKHPDATYSRCGSGPWITPRCLVDYPYRLWHYPCTVNYSIFKIRMYLGGVEHRLEAACNWTRGERCDLEDRDRSELSPLLLSTTQWQVLPCSFTTLPALSTGLIHLHQNIVDVQYLYGVGSSVASWAIKWDYVVLLFLLLADARICSCLWMMLLISQAEA

SEQ ID NO: 3 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETHVTGGSAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHPEATYSRCGSGPWITPRCMVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEA

SEQ ID NO: 4 - protein, 746 aa, Hepatitis C virus
MSTNPKPQRKTKRNTNRRPQDVKFPGGGQIVGGVYLLPRRGPRLGVRAVRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGIYHVTNDCPNSSIVYETADTILHSPGCVPCVREGNASKCWVALAPTVATRDGKLPTTQLRRHIDLLVGSATLCSALYVGDLCGSVFLVGQLFTFSPRRHWTTQDCNCSIYPGHITGHRMAWDMMMNWSPTTALVVAQLLRVPQAILDMIAGAHWGVLAGIAYFSMVGNWAKVLVVLLLFAGVDAETYTTGGSVAQAAFGLTSLFRPGPKQDIQLINTNGSWHINRTALNCNASLDTGWVAGLFYYHKFNSSGCPERMASCRSLADFDQGWGPISYANGSGPEHRPYCWHYPPKPCGIVPAQNVCGPVYCFTPSPVVVGTTNKLGVPTYSWGSNETDVLVLNNTRPPLGNWFGCTWMNSSGFTKVCGAPPCVIGGAGNRTLHCPTDCFRKHPEATYSRCGSGPWITPRCLVHYPYRLWHYPCTVNYTMFKVRMYVGGVEHRLEVACNWTRGERCDLDDRDRSELSPLLLSTTQWQVLPCSFTTLPALTTGLIHLHQNIVDVQYLYGVGSSIVSWAIKWEYVILLFLLLADARICSCLWMMLLISQAEA

SEQ ID NO: 5 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRSWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAFQVRNSSGLYHVTNDCPNSSIVYETADTILHSPGCVPCVREDNTSRCWVAVAPTVATRDGRLPTTQLRRHIDLLVGSATLCSALYVGDLCGSVFLVGQLFTFSPRRHWTTQDCNCSIYPGHITGHRMAWDMMMNWSPTTALVVAQLLRVPQAILDMIAGAHWGVLAGIAYFSMVGNWAKVLVVLLLFASVDAETYTSGGSVARATAGFAGIFNPGAKQDIQLINTNGSWHINRTALNCNASLDTGWVAGLFYYHKFNSSGCPERMASCKPLAHFAQGWGPISYANGSGPDHRPYCWHYPPKPCGIVPAQNVCGPVYCFTPSPVVVGTTNKLGAPTYNWGSNDTDVFILNNTRPPGGNWFGCTWMNSSGFTKVCGAPPCTIGGVGNNTLLCPTDCFRKHPEATYSRCGSGPWVTPRFLVHYPYRLWHYPCTVNYTLFKVRMYVGGVEHRLEVACNWTRGERCDLDDRDRSELSPLLLSTTQWQVLPCSFTTLPALTTGLIHLHQNIVDVQYLYGVGSSLVSWAIKWEYVILLFLLLADARICSCLWMMLLISQAEA

SEQ ID NO: 6 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETADTILHSPGCVPCVREGNTSKCWVAVAPTVATRDGKLPTTQLRRHIDLLVGSATLCSALYVGDLCGSVFLVGQLFTFSPRRHWTTQDCNCSIYPGHITGHRMAWDMMMNWSPTAALVTAQLLRVPQAILDMIAGAHWGVLAGIAYFSMAGNWAKVLLVLLLFAGVDAETYTTGGSVARTTRGLASLLQVGPKQDIRLIHTNGSWHINRTALNCNASLDTGWLAGLLYYHKFNSSGCPERMASCRPLADFDQGWGPISYANGSGPEHRPYCWHYPPKPCGIVPAQTVCGPVYCFTPSPVVVGTTNKLGVPTYTWGSNDTDVFVLNNTRPPLGNWFGCTWMNSTGFTKVCGAPPCVIGGVGNNTLHCPTDCFRKHPEATYSRCGSGPWITPRCLVDYPYRLWHYPCTVNYTLFKVRMYVGGVEHRLQAACNWTRGERCDLDDRDRSELSPLLLSTTQWQVLPCSFTTLPALTTGLIHLHQNIVDVQYLYGVGSSIVSWAIKWEYVILLFLLLADARICSCLWMMLLISQAEA

SEQ ID NO: 7 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETADTILHSPGCVPCVREDNASRCWVPVAPTVATRDGKLPTTQLRRHIDLLVGSATLCSALYVGDLCGSVFLVSQLFTFSPRRHWTTQDCNCSIYPGHITGHRMAWDMMMNWSPTVALVMAQLLRVPQAILDMIAGAHWGVLAGIAYFSMVGNWAKVLVVLLLFAGVDAQTYVTGGSAARGASGLANLFTPGAKQDIQLINTNGSWHINRTALNCNASLDTGWVAGLFYYHKFNSSGCPERMASCKPLADFDQGWGPIRHANGSGPEHRPYCWHYPPKPCGIVSAQTVCGPVYCFTPSPVVVGTTNRLGVPTYSWGTNDTDVFVLNNTRPPLGNWFGCTWMNSSGFTKVCGAPPCVIGGVGNNTLHCPTDCFRKHPEATYSRCGSGPWITPRCLVHYPYRLWHYPCTVNYTLFKVRMYVGGVEHRLEVACNWTRGERCDLDDRDRSELSPLLLSTTQWQVLPCSFTTLPALTTGLIHLHQNIVDVQYLYGVGSSIVSWAIKWEYVILLFLLLADARICSCLWMMLLISQAEA

SEQ ID NO: 8 - protein, 746 aa, Hepatitis C virus
MSTNPKPQRKTKRNTNRRPQDVKFPGGGQIVGGVYLLPRRGPRLGVRTTRKTSERSEPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETKDTILHSPGCVPCVREGNVSKCWVPVALTVATRDGNLPTTQLRRHIDLLVGSATLCSALYVGDLCGSVFLVGQLFTFSPRRHWTTQDCNCSMYPGHITGHRMAWDMMMNWSPTSALVVAQLLRVPQAILDMIAGAHWGVLAGLAYFSMVGNWAKVLVVLLLFASVDAGTHVTGGSAAHDVSALAGFFRRGAKQNIQLINTNGSWHVNRTALNCNASLDTGWVAGLLYYHRFNSSGCPERMASCRPLADFDQGWGPITNVDGGGSEYRPYCWHYPPKPCGIEPAQNVCGPVYCFTPSPVVVGTTDKVGVPTYNWGENDTDVFVLNNTRPPLGNWFGCTWMNSSGFVKVCGAPPCIIGGAGNKTLHCPTDCFRKHPDATYSRCGSGPWLTPRCLVDYPYRLWHYPCTVNYTLFKIRMYVGGVEHRLVAACNWTYGERCNLDDRDRSELSPLLLSTTQWQVLPCSFTTLPALTTGLIHLHQNIVDVQYLYGVGSSIVSWAIKWEYVILLFLLLADARICSCLWMMLLISQAEA

SEQ ID NO: 9 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETADTILHSPGCVPCVREGNASKCWVAVAPTVATRDGTLPTTQLRRHIDLLVGGATLCSALYVGDLCGSVFLVGQLFTFSPRRHWTTQDCNCSIYPGHITGHRMAWDMMMNWSPTTALIVAQLLRVPQAILDMIAGAHWGVLAGIAYFSMVGNWAKVLVVLLLFAGVDAETHVTGGSAAQVTSRVAGFFNPGPKQNVQLINTNGSWHINRTALNCNASLDTGWVAGLFYHYNFNSSGCPERMASCRPLADFDQGWGPISYANGSGPEHRPYCWHYPPKPCGIVPAQNVCGPVYCFTPSPVVVGTTNRLGVPTYNWGSNDTDVFVLNNTRPPLGNWFGCTWMNSSGFTKVCGAPPCVIGGVGNNTLHCPTDCFRKHPEATYSRCGSGPWITPRCLVHYPYRLWHYPCTVNYTLFKVRMYVGGVEHRLEAACNWTRGERCDLDDRDRSELSPLLLSTTQWQVLPCSFTTLPALTTGLIHLHQNIVDVQYLYGVGSSIVSWAIKWEYVILLFLLLADARICSCLWMMLLISQAEA

SEQ ID NO: 10 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRSWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGIYHVTNDCPNSSIVYETADTILHSPGCVPCVREGNASKCWVALAPTVATRDGRLPTTQLRRHIDLLVGSATLCSALYVGDLCGSVFLVGQLFTFSPRRHWTTQDCNCSIYPGHITGHRMAWDMMMNWSPTTALVVAQLLRIPQAILDMIAGAHWGVLAGIAYFSMVGNWAKVLVVLLLFAGVDAHTRVTGGSAARATARLTTLFSPGAKQDIQLINTNGSWHINRTALNCNASLDTGWVAGLFYYHKFNSSGCPERMASCRPLADFDQGWGPISYANGSGPEHRPYCWHYPPKPCGIIPAKTVCGPVYCFTPSPVVVGTTDRSGAPTFNWGDNDTDVLVLNNTRPPLGNWFGCTWMNSSGYTKVCGAPPCIIGGVGNNTLHCPTDCFRKHPEATYSRCGSGPWITPRCLVHYPYRLWHYPCTVNYTLFKVRMYVGGVEHRLEAACNWTRGERCNLDDRDRSELSPLLLSTTQWQVLPCSFTTLPALTTGLIHLHQNIVDVQYLYGVGSSIVSWAIKWEYVILLFLLLADARVCSCLWMMLLISQVEA

SEQ ID NO: 11 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETADTILHSPGCVPCVREGNASKCWVAVTPTVATRDGRLPATQLRRHIDLLVGSATLCSALYVGDLCGSIFLVGQLFTFSPRRHWTTQDCNCSIYPGHITGHRMAWDMMMNWSPTTALVVAQLLRVPQAILDMIAGAHWGVLAGIAYFSMVGNWAKVLVVLLLFAGVDAGTHVTGGSAAKDTSGFTSLFRIGARQNIQLINSNGSWHINRTALNCNESLDTGWVAGLLYYHKFNSSGCPERMASCRSLADFDQGWGPISYANGSGPEHRPYCWHYPPKPCGIVPAQSVCGPVYCFTPSPVVVGTTDKSGAPTYNWGCNETDVFVLNNTRPPLGNWFGCTWMNSSGFTKVCGAPPCVIGGVGNNTLHCPTDCFRKHPEATYSRCGSGPWITPRCLVHYAYRLWHYPCTVNYTLFKVRMYVGGVEHRLDVACNWTRGERCNLDDRDRSELSPLLLSTTQWQVLPCSFTTLPALSTGLIHLHQNIVDVQYLYGVGSSIVSWAIKWEYVILLFLLLADARICSCLWMMLLISQAEA

SEQ ID NO: 12 - protein, 746 aa, Hepatitis C virus; identical to SEQ ID NO: 11

SEQ ID NO: 13 - protein, 746 aa, Hepatitis C virus; identical to SEQ ID NO: 11

SEQ ID NO: 14 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETADSILHSPGCVPCVREGNASKCWVAVAPTVATRDGKLPATQLRRHIDLLVGSATLCSALYVGDLCGSVFLVSQLFTFSPRRHWTTQDCNCSIYPGHITGHRMAWDMMMNWSPTTALVVSQLLRVPQAILDMIAGAHWGVLAGIAYFSMVGNWAKVLVVLLLFAGVDAETHTTGGSAAYATSGFVGLFRQGAKQNIQLINTNGSWHVNRTALNCNASLDTGWVAGLFYYHKFNSSGCPERLASCKPLANFDQGWGSISYTNGSGPEHRPYCWHYPPKPCGIVPAQNVCGPVYCFTPSPVVVGTTDRLGAPTFNWGENESDVFVLNNTRPPSGNWFGCTWMNSSGFTKVCGAPPCNIGGVGNNTLHCPTDCFRKHPEATYSRCGSGPWVTPRCLVHYPYRLWHYPCTLNYSLFKVRMYVGGIEHRLEVACNWTRGERCNLDDRDRSELSPLLLTTTQWQVLPCSFTTLPALTTGLIHLHQNVVDVQYLYGVGSSIVSWAIKWEYVILLFLLLADARICSCLWMMLLISQAEA

SEQ ID NO: 15 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYETADTILHSPGCVPCVREGNASKCWVAVAPTVATRDGRLPTTQLRRHIDLLVGSATLCSALYVGDLCGSVFLVGQLFTFSPRHHWTTQDCNCSIYPGHITGHRMAWDMMMNWSPTTALVVAQLLRVPQAILDMIAGAHWGVLAGIAYFSMVGNWAKVLVVLLLFAGVDATTHTTGGAVAHNTRMFTSIFSLGPRQEIQLVNTNGSWHINRTALNCNASLETGWIAGLLYANRFNSSGCPERMASCKPLADFDQGWGPISYANGSGPEHRPYCWHYPPKPCGIVPAQNVCGPVYCFTPSPVVVGTTDRLGTPTYDWGSNDTDVFVLNNTRPPAGNWFGCTWMNSSGYTKVCGAPPCVIGGVSNNTLHCPTDCFRKHPEATYSRCGSGPWITPRCLVHYAYRLWHYPCTVNYTLFKVRMYVGGVEHRLEVACNWTRGERCNLDDRDRSELSPLLLSTTQWQVLPCSFTTLPALTTGLIHLHQNIVDVQYLYGVGSSIVSWAVKWEYVILLFLLLADARICSCLWMMLLISQAEA

SEQ ID NO: 16 - protein, 746 aa, Hepatitis C virus
MSTNPKPQRKTKRNTNRRPQDVKFPGGGQIVGGVYLLPRRGPRLGVRATRKTSERSQPRGRRQPIPKARQPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGVYHVTNDCSNASIVYEAADMIMHTPGCVPCVRENNSSRCWVALTPTLAARNASVPTTTIRRHVDLLVGAAALCSAMYVGDLCGSVFLVAQLFTFSPRRHETVQDCNCSIYPGHVTGHRMAWDMMMNWSPTAALVVSQLLRIPQAVVDMVAGAHWGVLAGLAYYSMVGNWAKVLIVMLLFAGVDGGTYVTGGTMAKNTLGITSLFSPGSSQKIQLVNTNGSWHINRTALNCNDSLNTGFLAALFYVHKFNSSGCPERMASCSPIDAFAQGWGPITYNESHSSDQRPYCWHYAPRPCGIVPAAQVCGPVYCFTPSPVVVGTTDRFGVPTYSWGENETDVLLLNNTRPPQGNWFGCTWMNSTGFTKTCGGPPCNIGGIGNKTLTCPTDCFRKHPEATYTKCGSGPWLTPRCLVHYPYRLWHYPCTVNFTIFKVRMYVGGVEHRLEAACNWTRGERCNLEDRDRSELSPLLLSTTEWQVLPCSFTTLPALSTGLIHLHQNVVDVQYLYGIGSAVVSFAIKWEYVLLLFLLLADARVCACLWMMLLIAQAEA

SEQ ID NO: 17 - protein, 746 aa, Hepatitis C virus
MSTNPKPQRKTKRNTNRRPQDVKFPGGGQIVGGVYLLPRRGPRLGVRATRKTSERSQPRGRRQPIPKARQPEGRAWAQPGYPWPLYGNEGMGWAGWLLSPRGSRPSWGPTDPRRRSRNLGKVIDTLTCGFADLMGYIPLVGAPLGGVARALAHGVRVVEDGVNYATGNLPGCSFSIFLLALLSCLTIPASAYEVRNVSGIYHVTNDCSNSSIVYEAADMIMHTPGCVPCVREGNSSRCWVALTPTLAARNASVPTTAIRRHVDLLVGAAAFCSAMYVGDLCGSVFLVSQLFTFSPRRHETIQDCNCSIYPGHVSGHRMAWDMMMNWSPTTALVVSQLLRIPQAIVDMVAGAHWGVLAGLAYYSMVGNWAKVLIVMLLFAGVDGETRVTGGQIARNAYSLTTLFSSGSAQNIQLINTNGSWHINRTALNCNDSLNTGFLAALFYTHKFNASGCPERLASCRPIDKFDQGWGPITYAEQGGQDQRPYCWHYAPKPCGIVSASKVCGPVYCFTPSPVVVGTTDRFGVPTYSWGENETDVLLLNNTRPPQGNWFGCTWMNGTGFTKTCGGPPCNIGGGGNNTLTCPTDCFRKHPAATYTKCGSGPWLTPRCLVDYPYRLWHYPCTANFTIFKVRMYVGGVEHRLDAACNWTRGERCNLEDRDRLELSPLLLSTTEWQVLPCSFTTLPALSTGLIHLHQNIVDVQYLYGIGSAVVSFAIKWDYIVILFLLLADARVCACLWMMLLIAQAEA

SEQ ID NO: 18 - protein, 747 aa, Hepatitis C virus
MSTNPKPQRKTKRNTNRRPQDVKFPGGGQIVGGVYLLPRRGPRLGVRAIRKTSERSQPRGRRQPIPKARRPEGRAWAQPGYPWPLYGNEGMGWAGWLLSPRGSRPSWGPTDPRRRSRNLGKVIDTLTCGLADLMGYIPLVGGPLGGAARALAHGVRVLEDGVNYATGNLPGCSFSIFLLALLSCLTVPASAHEVRNASGVYHVTNDCSNSSIVFEAADLIMHTPGCVPCVREGNSSRCWVALTPTLAARNATIPTTTIRHHVDLLVGAAALCSAMYVGDLCGSVFLVSQLFTFSPRRHATLQDCNCSIYPGHASGHRMAWDMMMNWSPTTALVVSQLLRIPQAVIDMVAGAHWGVLAGLAYYSMAGNWAKVLIVMLLFAGVDGHTLTTGGHAARLTSGFAGLFTPGPSQRIQLINTNGSWHINRTALNCNDSLQTGFLAALFYAHRFNSSGCPERMASCRSIDKFDQGWGPITYAEPTKDPDQRPYCWHYPPQQCGIVPASQVCGPVYCFTPSPVVVGTTDRLGNPTYSWGENDTDVLLLNNTRPPQGNWFGCTWMNSTGFTKTCGAPPCNIGGVGNNTLTCPTDCFRKHPEATYSKCGSGPWLTPRCMVDYPYRLWHYPCTVNFSIFKVRMYVGGVEHRLNAACNWTRGERCNLDDRDRSELSPLLLSTTEWQVLPCSFTTLPALSTGLIHLHQNIVDVQYLYGIGSAVVSFAIKWEYVVLLFLLLADARVCACLWMMLLIAQAEA

SEQ ID NO: 19 - protein, 746 aa, Hepatitis C virus
MSTNPKPQRKTKRNTNRRPQDVKFPGGGQIVGGVYLLPRRGPRLGVRATRKTSERSQPRGRRQPIPKARHPEGRTWAQPGYPWPLYGNEGLGWAGWLLSPRGSRPSWGPTDPRRRSRNLGKVIDTLTCGFADLMGYIPLVGAPLGGVARALAHGVRVLEDGVNYATGNLPGCSFSIFLLALLSCLTIPASAYEVRNVSGVYHVTNDCSNSSIVYEAADVIMHTPGCVPCVQDGNTSRCWVALTPTLAARNASVPVTAIRRHVDLLVGTAAFCSAMYVGDLCGSVFPVSQLFTFSPRRHQTVQDCNCSIYPGHISGHRMAWDMMMNWSPTAALVVSQLLRIPQAIVDMVAGAHWGVLAGLAYYSMVGNWAKVMIVLLLFAGVDGTTHTTGGAAARATQGFTSFFSLGPSQKIQLINTNGSWHINRTALNCNDSLQTGFLAALFYTYRFNASGCPERMASCRPIDKFDQGWGPITYAEPDSSDQRPYCWHYAPRPCGIVPASQVCGPVYCFTPSPVVVGTTDRFGVPTYTWGENETDVLLLNNTRPPLGNWFGCTWMNSTGFTKTCGGPPCNIGGAGNTTLTCPTDCFRKHPEATYTKCGSGPWLTPRCLVDYPYRLWHYPCAVNFTIFKVRMYVGGVEHRLNAACNWTRGERCDLEDRDRSELSPLLLSTTEWQVLPCSFTTLPALSTGLIHLHQNIVDVQYLYGIGSAVIPFAIKWEYVLLLFLLLADARVCACLWMMLLIAQAEA

SEQ ID NO: 20 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGMGWAGWLLSPRGSRPNWGPTDPRRRSRNLGKVIDTLTCGFADLMGYIPLVGAPLGGVARALAHGVRVLEDGVNYATGNLPGCSFSIFLLALLSCLTTPASAYEVRNVSGIYHVTNDCSNSSIVYEAADIIMHTPGCVPCVREKNISRCWVALTPTLAARNISVPTATIRRHVDLLVGTAAFCSAMYVGDLCGSVFLVSQLFTFSPRWHETVQDCNCSLYPGHVSGHRMAWDMMMNWSPTAALVVSQLLRIPQAVVDMVAGAHWGVLAGLAYYSMIGNWAKVLIVMLLFAGADGTTHVTGGVQAHGAYGLASLFNVGPHQKIQLVNTNGSWHINRTALNCNDTLQTGFLAALFYKHRFNASGCPERMASCRPIDKFAQGWGPITYAEPDRLDQRPYCWHYPPRPCGIVPALEVCGPVYCFTPSPVVVGTTDRFGVPTYSWGENETDVLLLNNTRPPQGNWFGCTWMNSTGYTKTCGGPPCNIGGVGNNTLTCPTDCFRKHPEATYTKCGSGPWLTPRCLVHYPYRLWHYPCTVNFTIFKVRMYVGGIEHRLDAACNWTRGERCDLEDRDRSELSPLLLSTTEWQILPCSFTTLPALSTGLIHLHRNIVDVQYLYGIGSAVVSFAIKWEYVLLLFLLLADARVCACLWMMLLIAQAEA

SEQ ID NO: 21 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGLGWAGWLLSPRGSRPSWGPNDPRRRSRNLGKVIDTLTCGFADLMGYIPLVGAPLGGAARALAHGVRVLEDGVNYATGNLPGCSFSIFLLALLSCLTIPASAYEVRNVSGIYHVTNDCSNSSIVYEAADVIMHAPGCVPCVRENNSSRCWVALTPTLAARNASVPTTTLRRHVDLLVGTAAFCSAMYVGDLCGSVFLISQLFTFSPRRHETVQDCNCSIYPGHVSGHRMAWDMMMNWSPTAALVVSQLLRIPQAVMDMVAGAHWGVLAGLAYYSMVGNWAKVLIVMLLFAGVDGHTRVTGGVQGHVTSTLTSLFRPGASQKIQLVNTNGSWHINRTALNCNDSLKTGFLAALFYTHKFNASGCPERMASCRSIDKFDQGWGPITYAQPDNSDQRPYCWHYAPRQCGIVPASQVCGPVYCFTPSPVVVGTTDRFGAPTYNWGDNETDVLLLNNTRPPHGNWFGCTWMNSTGFTKTCGGPPCNIRGVGNNTLTCPTDCFRKHPDATYTKCGSGPWLTPRCLVDYPYRLWHYPCTVNFTIFKVRMYVGGVEHRLDAACNWTRGERCDLEDRDRAELSPLLLSTTEWQILPCSYTTLPALSTGLIHLHQNIVDIQYLYGIGSAVVSIAIKWEYVVLLFLLLADARVCACLWMMLLIAQAEA

SEQ ID NO: 22 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGDEGMGWAGWLLSPRGSRPNWGPTDPRRRSRNLGKVIDTLTCGFADLMGYIPLVGAPLGGVARALAHGVRVLEDGVNYATGNLPGCSFSIFLLALLSCLTTPASAYEVRNVSGIYHVTNDCSNSSIVYEAADIIMHTPGCVPCVREKNTSRCWVALTPTLAARNISVPTTTIRRHVDLLVGTAAFCSAMYVGDLCGSVFLVSQLFTFSPRRHETVQDCNCSLYPGHVSGHRMAWDMMMNWSPTAALVVSQLLRIPQAIVDMVAGAHWGVLAGLAYYSMVGNWAKVLIVMLLFAGADGTTHVTGGVQAHGAYGLASLFNVGPHQKIQLVNTNGSWHINRTALNCNDTLQTGFLAALFYKHRFNASGCPERMASCRPIDKFAQGWGPITYAEPDRLDQRPYCWHYPPRPCGIVPALEVCGPVYCFTPSPVVVGTTDRFGVPTYSWGENETDVLLLNNTRPPQGNWFGCTWMNNTGFTKTCGGPPCNIGGVGNNTLTCPTDCFRKHPEATYTKCGSGPWLTPRCLVDYPYRLWHYPCTVNFTVFKVRMYVGGIEHRLDAACNWTRGERCDLEDRDRSELSPLLLSTTEWQILPCSFTTLPALSTGLIHLHRNIVDVQYLYGIGSAVVSFAIKWEYILLLFLLLADARVCACLWMMLLIAQAEA

SEQ ID NO: 23 - protein, 746 aa, Hepatitis C virus
MSTNPKPQRKTKRNTNRRPQDVKFPGGGQIVGGVYLLPRRGPRLGVRATRKTSERSQPRGRRQPIPKARQPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGVYHVTNDCSNSSIVYEAADMIMHTPGCVPCVREDNSSRCWVALTPTLAARNSSVPTTTIRRHVDLLVGAAAFCSAMYVGDLCGSVFLISQLFTFSPRRYETVQDCNCSLYPGHVSGHRMAWDMMMNWSPTTALVVSQLLRIPQAVVDMVAGAHWGVLAGLAYYSMVGNWAKVLIVMLLFAGVDGNTRVSGGEAAKNTMGFASLFVSGPSQKIQLINTNGSWHINRTALNCDDSLHTGFLAALFYAHKFNSSGCSGRMASCRPIDEFAQGWGPITHGVPDNLDQRPYCWHYAPRPCGIVPASQVCGPVYCFTPSPVVVGTTDRFGAPTYSWGENETDVLLLNNTRPPQGNWFGCTWMNSTGFTKTCGGPPCNIGGVGNNTLTCPTDCFRKHPEATYTKCGSGPWLTPRCMVDYPYRLWHYPCTVNFTIFKVRMYVGGVEHRLDAACNWTRGERCNVEDRDRSELSPLLLSTTEWQILPCSFTTLPALSTGLIHLHQNIVDVQYLYGVGSVVVSVVIRWEYVVLLFLLLADARVCACLWMMLLIAQAEA

SEQ ID NO: 24 - protein, 746 aa, Hepatitis C virus
MSTNPKPQRKTKRNTNRRPQDVKFPGGGQIVGGVYLLPRRGPRLGVRATRKTSERSQPRGRRQPIPKARQPEGRAWAQPGYPWPLYGNEGMGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGMYHVTNDCSNSSIVYEAADMILHAPGCVPCVRENNSSRCWVALTPTLAARNASVPTTAIRRHVDLLVGAAAFCSAMYVGDLCGSVLLVSQIFTFSPRRHETMQDCNCSIYPGHITGHRMAWDMMMNWSPTTALVVSQLLRIPQAIVDMVAGAHWGVLAGLAYYSMVGNWAKVLIVMLLFAGVDGGTYVTGGEAGRRTSGFASIFTPGASQNIQLINTNGSWHINRTALNCNDSLHTGFIAALFYHHKFNASGCPERMASCRPIGEFAQGWGPISYTEPPSSDQRPYCWHYPPRPCGIVPASQVCGPVYCFTPSPVVVGTTDRLGAPTYNWGDNDTDVLLLNNTRPPQGNWFGCTWMNGTGFTKTCGGPPCNIGGVGNNTLTCPTDCFRKHPEATYTKCGSGPWLTPRCIVDYPYRLWHYPCTVNFTITKIRMYVGGVEHRLTAACNWTRGERCDLEDRDRSELSPLLLSTTEWQIMPCSFTTLPALSTGLIHLHQNIVDIQYLYGIGSAAVSFAIRWEYVLLLFLLLADARVCACLWMMLLIAQAEA

SEQ ID NO: 25 - protein, 746 aa, Hepatitis C virus; identical to SEQ ID NO: 24

SEQ ID NO: 26 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRAWAQPGYPWPLYGNEGLGWAGWLLSPRGSRPSWGPTDPRRRSRNLGKVIDTLTCGFADLMGYIPLVGAPLGGTARALAHGVRVLEDGVNYATGNLPGCSFSIFLLALLSCLTIPASAYEVRNVSGVYHVTNDCSNSSIVYETADMIMHTPGCVPCVREDNFTRCWVALTPTLAARNGSVPTTAIRRHVDLLVGAAAFCSAMYVGDLCGSVFLVSQLFTFSPRWHETVQECNCSIYPGHVTGHRMAWDMMMNWSPTTALVVSQLLRIPQAVVDMVAGAHWGVLAGLAYYSMVGNWAKVLIVTLLFAGVDGNTHTIGGKQAQATGGFVAWLARGPSQEIQLINTNGSWHINRTALNCNDSLKTGFIAALFYAHRFNSSGCPERMASCRPIDKFAQGWGPITYAKPDSLDQRPYCWHYAPQPCGIVPASEVCGPVYCFTPSPVVVGTTDRSGVPTYRWGENETDVLLLNNTRPPQGNWFGCTWMNATGFTKTCGGPPCKIGGLGNNTLTCPTDCFRKHPEATYTKCGSGPWLTPRCIVDYPYRLWHYPCTVNFTIFKVRMYVGGIEHRLSAACNWTRGERCDLEDRDRSELSPLLLSTTEWQILPCSFTTLPALSTGLIHLHQNTVDVQYLYGVGSVLVSFAIKWEYILLFFLLLADARVCACLWMMLLIAQAEA

SEQ ID NO: 27 - protein, 746 aa, Hepatitis C virus
MSTNPKPQRKTKRNTNRRPQNVKFPGGGQIVGGVCLLPRRGPRVGVRATRKTSERSQPRGRRQPIPKARRPEGRSWAQPGYPWPLYGNEGCGWAGWLLSPRGSRPSRGPSDPRRRSRNLGKVIDTLTCGFADLMGYIPLVGAPLGGAARALAHGVRVLEDGVNYATGNLPGCSFSIFLLALLSCLTVPASAVEVRNSSGIYHVTNDCPNASVVYETDSLIIHLPGCVPCVREGNASRCWVSLSPTVAAKDPGVPVNEIRRHVDLIVGAAAFCSAMYVGDLCGSIFLVGQLFTLSPRRHWTTQDCNCSIYPGHVTGHRMAWDMMMNWSPTGALVVAQLLRIPQAVLDMIAGAHWGVLAGPAYYSMVGNWAKVLVVLLLFAGVDATTQVTGGTAGRNAYRLASLFSTGPSQNIQLINSNGSWHINRTALNCNDSLHTGWVAALFYSHKFNSSGRPERMASCRPLTAFDQGWGPITYGGKASNDQRPYCWHYAPRPCGIVPAKEVCGPVYCFTPSPVVVGTTDKYGVPTYTWGENETDVLLLNNSRPPIGNWFGCTWMNSTGFTKTCGAPACNVGGSETNTLSCPTDCFRRHPDATYAKCGSGPWLNPRCMVDYPYRLWHYPCTVNYTIFKIRMFVGGIEHRLTAACNWTRGERCDLDDRDRAELSPLLLSTTQWQVLPCSFTTLPALSTGLIHLHQNIVDVQYLYGLSSVVTSWAIRWEYVVLLFLLLADARICACLWMMLLISQVEA

SEQ ID NO: 28 - protein, 746 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTYGFADLMGYIPLVGAPLGGAARALAHGVRVLEDGVNYATGNLPGCSFSIFLLALLSCLTVPASAVGVRNSSGVYHVTNDCPNASVVYETDSLIIHLPGCVPCVREGNGSRCWVSLSPTVAAKDPGVPVNEIRRHVDLIAGAAAFCSAMYVGHLCGSIFLVGQLFTLSPRRHWTTQDCNCSIYPGHVTGHRMAWDMMMNWSPTTALVVAQLLRIPQAILDMIAGAHWGVLAGIAYFSMVGNWTKVLVVLLLFAGVDATTIVSGGSAGRSTAGLVGLFSPGARQNIQLINTNGSWHINRTALNCNDTLQTGWVAGLFYTNKFNSSGCPERLASCRPLADFDQGWGPISYTNGSGPDQRPYCWHYPPKPCGIVPAESVCGPVYCFTPSPVVVGTTDRSGAPTYNWGENETDVFVLNNTRPRLGNWFGGTWMNSTGFTKVCGAPPCAIGGVGNNTLYCPTDCFRKHPEATYSRCGSGPWITPRCLIHYPYRLWHYPCTINYTIFKIRMFVGGVEHRLDAACNWTRGERCDLDDRDRAELSPLLLSTTQWQVLPCSFTTLPALSTGLIHLHQNIVDVQYLYGLSSAVTSWVIKWEYVVLLFLLLADARICACLWMMLLISQVEA

SEQ ID NO: 29 - protein, 746 aa, Hepatitis C virus
MSTNPKPQRKTKRNTNRRPQDVKFPGGGQIVGGVYLLPRRGPRVGVRATRKTSERSQPRGRRQPIPKARRPEGRSWAQPGYPWPLYGNEGCGWAGWLLSPRGSRPSWGPSDPRRRSRNLGKVIDTLTCGFADLMGYIPLVGAPLGGAARALAHGVRVLEDGVNYATGNLPGCSFSIFLLALLSCLTVPASAVGVRNSSGVYHVTNDCPNASVVYETENLIMHLPGCVPYVREGNASRCWVSLSPTVAARDSRVPVSEVRRRVDSIVGAAAFCSAMYVGDLCGSIFLVGQIFTFSPRHHWTTQDCNCSIYPGHVTGHRMAWDMMMNWSPTGALVVAQLLRIPQAIVDMIAGAHWGVLAGLAYYSMVGNWAKVVVVLLLFAGVDAETRVTGGAAGHTAFGFASFLAPGAKQKIQLINTNGSWHINRTALNCNESLDTGWLAGLLYYHKFNSSGCPERMASCQPLTAFDQGWGPITHEGNASDDQRPYCWHYALRPCGIVPAKKVCGPVYCFTPSPVVVGTTDRAGVPTYRWGANETDVLLLNNSRPPMGNWFGCTWMNSSGFTKTCGAPACNIGGSGNNTLLCPTDCFRKHPDATYSRCGSGPWLTPRCLVDYPYRLWHYPCTVNYTIFKIRMFVGGVEHRLDAACNWTRGERCDLDDRDRAELSPLLLSTTQWQVLPCSFTTLPALSTGLIHLHQNIVDVQYLYGLSSAVTSWVIKWEYVVLLFLLLADARICACLWMMLLISQVEA

SEQ ID NO: 30 - protein, 750 aa, Artificial Sequence
  Synthetic Sequence
  misc_feature (233)..(233): Xaa can be any naturally occurring amino acid
  misc_feature (249)..(250): Xaa can be any naturally occurring amino acid
  misc_feature (290)..(290): Xaa can be any naturally occurring amino acid
  misc_feature (378)..(378): Xaa can be any naturally occurring amino acid
  misc_feature (392)..(392): Xaa can be any naturally occurring amino acid
  misc_feature (399)..(399): Xaa can be any naturally occurring amino acid
  misc_feature (445)..(445): Xaa can be any naturally occurring amino acid
  misc_feature (495)..(495): Xaa can be any naturally occurring amino acid
  misc_feature (599)..(599): Xaa can be any naturally occurring amino acid
  misc_feature (628)..(628): Xaa can be any naturally occurring amino acid
  misc_feature (664)..(664): Xaa can be any naturally occurring amino acid
  misc_feature (683)..(683): Xaa can be any naturally occurring amino acid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPTDPRHRSRNVGKVIDTLTCGFADLMGYIPVVGAPLGGVARALAHGVRVLEDGVNYATGNLPGCSFSIFLLALLSCITVPVSAVEVKNISTSYMVTNDCSNDSITWQLQAAVLHVPGCVPCENDXNTSRCWIPVSPNVAVXXPGALTQGLRTHIDMVVMSATLCSALYVGDLCGGVMLAAQXFIVSPQRHWFVQECNCSIYPGTITGHRMAWDMMMNWSPTATMILAYAMRVPEVIIDIIFGAHWGVMFGLAYFSMQGAWAKVIVILLLXAGVDARTHTVGGSXGRTTSGXAGLFSSGPKQNIQLINTNGSWHINRTALNCNDSLQTGFIASLFYTXNFNSSGCPERLSACRGIEAFRIGWGTLQYEDNVTNPEDMRPYCWHYPPKXCGIVPARSVCGPVYCFTPSPVVVGTTDRLGVPTYTWGENETDVFLLNSTRPPRGSWFGCTWMNSTGFTKTCGAPPCRIRADFNASTDLLCPTDCFRKHPDATYXKCGSGPWLTPRCLVDYPYRLWHYPCTVNXTIFKIRMYVGGVEHRLTAACNFTRGDRCNLEDRDRXQLSPLLHSTTEWAILPCSXSDLPALSTGLLHLHQNIVDVQYMYGLSPALTKYIVRWEWVVLLFLLLADARVCACLWMLILLGQAEA

SEQ ID NO: 31 - protein, 750 aa, Hepatitis C virus
MSTNPKPQRKTKRNTNRRPEDVKFPGGGQIVGGVYLLPRRGPRLGVRTTRKTSERSQPRGRRQPIPKDRRSTGKAWGKPGRPWPLYGNEGLGWAGWLLSPRGSRPSWGPTDPRHRSRNVGKVIDTLTCGFADLMGYIPVVGAPLSGAARAVAHGVRVLEDGVNYATGNLPGFPFSIFLLALLSCITVPVSAAQVKNTSSSYMVTNDCSNDSITWQLEAAVLHVPGCVPCERVGNTSRCWVPVSPNMAVRQPGALTQGLRTHIDMVVMSATFCSALYVGDLCGGVMLAAQVFIVSPQYHWFVQECNCSIYPGTITGHRMAWDMMMNWSPTATMILAYVMRVPEVIIDIVSGAHWGVMFGLAYFSMQGAWAKVIVILLLAAGVDAGTTTVGGAVARSTNVIAGVFSHGPQQNIQLINTNGSWHINRTALNCNDSLNTGFLAALFYTNRFNSSGCPGRLSACRNIEAFRIGWGTLQYEDNVTNPEDMRPYCWHYPPKPCGVVPARSVCGPVYCFTPSPVVVGTTDRRGVPTYTWGENETDVFLLNSTRPPQGSWFGCTWMNSTGFTKTCGAPPCRTRADFNASTDLLCPTDCFRKHPDATYIKCGSGPWLTPKCLVHYPYRLWHYPCTVNFTIFKIRMYVGGVEHRLTAACNFTRGDRCDLEDRDRSQLSPLLHSTTEWAILPCTYSDLPALSTGLLHLHQNIVDVQYMYGLSPAITKYVVRWEWVVLLFLLLADARVCACLWMLILLGQAEA

SEQ ID NO: 32 - protein, 749 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPTDPRHRSRNVGKVIDTLTCGFADLMGYIPVVGAPLGGVARALAHGVRVLEDGVNYATGNLPGCSFSIFLLALLSCITTPVSAAQVKNTSDIYMVTNDCSNDSITWQLQAAALHVPGCVPCERVGNTSRCWIPVSPNVAVRQPGALTQGLRTHIDMVVMSATLCSALYVGDLCGGVMLAAQMFIISPQHHWFVQECNCSIYPGTITGHRMAWDMMMNWSPTTTMILAYVMRVPEVIIDIIGGAHWGVMFGLAYFSMQGAWAKVVVILLLAAGVDAHTRTGSSVGYATSGIVGLFTSGPKQNIQLINTNGSWHINRTALNCNDSLNTGFIVSLFYARNFNSTGCPERLSACRGIEGFRIGWGTLQYEDNVTNPEDMRPYCWHYPPKQCGIVPAGSVCGPVYCFTPSPVVVGTTDRLGVPTYTWGENETDVFLLNSTRPPVGSWFGCTWMNSTGFTKTCGAPPCRIRADFNASTDLLCPTDCFRKHPEATYIKCGSGPWLTPRCLVDYPYRLWHYPCTVNYSIFKIRMYVGGVEHRLTAACNFTRGDRCNLEDRDRSQLTPLLHSTTEWAILPCTYSDLPALSTGLLHLHQNIVDVQYMYGLSPALTKYVVRWEWVVLLFLLLADARVCACVWMLILLGQAEA

SEQ ID NO: 33 - protein, 750 aa, Hepatitis C virus
  misc_feature (458)..(458): Xaa can be any naturally occurring amino acid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPTDPRHRSRNVGKVIDTLTCGFADLMGYIPVVGAPLGGVARALAHGVRVLEDGVNYATGNLPGCSFSIFLLALLSCVTVPVSAVQVKNTSETYMVTNDCSNDSITWQLQAAVLHVPGCVPCERTGNTSRCWIPVSPNVAVQQPGALTQGLRTHIDMVVMSATLCSALYVGDLCGGVVLAAQLFIVSPRRHWFVQECNCSIYPGAITGHRMAWDMMMNWSPTTTMVLAYAMRVPEVIIDIISGAHWGVMFGLAYFSMQGAWAKVAVILLLTAGVEARTHTTGSVAGRTTSGFAGIFTSGPKQNIQLINTNGSWHINRTALNCNDSLNTGFMAALFYTKNFNSSGCPERLSXCRNIEAFRIGWGTLQYEDDVTNPEDMRPYCWHYPPKQCGIFPAGSVCGPVYCFTPSPVVVGTTNKLGVPTYTWGENETDVFILNSTRPPRGSWFGCTWMNSTGFTKTCGAPPCRIRADFNASTDLLCPTDCFRKHPEATYIKCGSGPWLTPRCLVDYPYRLWHYPCTVNYSIFKIRMYVGGVEHRLTAACNFSRGDRCNLEDRDRSQLTPLLHSTTEWAILPCSYSDLPALSTGLLHLHQNIVDVQYMYGLTPALTKYVVRWEWVVLLFLLLADARVCACLWMLILLGQAEA

SEQ ID NO: 34 - protein, 750 aa, Hepatitis C virus
MSTNPKPQRKTKRNTSRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPTDPRHRSRNVGKVIDTLTCGFADLMGYIPVVGAPLGGVARALAHGVRVLEDGVNYATGNLPGCSFSIFLLALLSCITVPVSAVQVKNISDSYMVTNDCSNDSITWQLQAAVLHVPGCVPCEKMGNISRCWIPVSPNVAVQRPGALTQGLRAHIDMVVMSATLCSALYVGDLCGGVMLAAQMFIVSPQHHHFVQECNCSIYPGAITGHRMAWDMMMNWSPTATMILAYAMRVPEVIIDIISGAHWGVMFGLAYFSMQGAWAKVVVILLLTAGVDAHTRSIAGSVAHATSGLAGLFTSGAKQNIQLINTNGSWHINRTALNCNDSLNTGFIASLFYTYRFNSSGCPERLSACRGIQAFRIGWGTLRYEDNVTNPEDMRPYCWHYPPKQCGIVSARSVCGPVYCFTPSPVVVGTTDRLGVPTYTWGENETDVFILNSTRPPGGSWFGCTWMNSTGFTKTCGAPPCRIRADFNASMDLLCPTDCFRKHPDATYIKCGSGPWLTPRCLVDYPYRLWHYPCTINYTIFKIRMYVGGVEHRLTAACNFTRGDPCNLEDRDRSQLSPLLHSTTEWAILPCSYSDLPALSTGLLHLHQNIVDVQYMYGLSPALTKYIVRWEWVVLLFLLLADARVCACLWMLILLGQAEA

SEQ ID NO: 35 - protein, 751 aa, Hepatitis C virus
MSTNPKPQRKTQRNTNRRPQDVKFPGGGQIVGGVYLLPRRGPRLGVRTARKTSERSQPRGRRQPIPKDRRSTGKSWGRPGYPWPLYGNEGLGWAGWLLSPRGSRPSWGPTDPRHRSRNVGKVIDTLTCGFADLMGYIPVVGAPLGGVARALAHGVRVLEDGVNYATGNLPGCSFSIFLLALLSCITIPASAVEVKNTSTGYMVTNDCANSSITWQLHAAVLHVPGCVPCERVDNNTSRCWIPVSPNIAVQRPGALTQGLRSHIDIVVMSATLCSALYVGDLCGGVMLAAQMFVVSPEHHWFVQECNCSIYPGTITGHRMAWDMMMNWSPTATMILAYAMRVPEVIIDIIGGAHWGVMFGLAYFSMQGAWAKVVVILLLAAGVDAYTHTVGGAAASTANSIAGLLSRGPRQNLQLINSNGSWHINRTALNCHDSLQTGFITALFYARHFNSSGCPERLAACRNIEAFRVGWGALQYEDNVTNPEDMRPYCWHYPPKQCGIVPARSVCGPVYCFTPSPVVVGTTDKLGVPTYTWGENETDVFLLNSTRPPQGPWFGCTWMNSTGFTKTCGAPPCRTRADFNASTDLLCPTDCFRKHPDATYNKCGSGPWLTPRCLIDYPYRLWHYPCTVNYTTFKIRMYVGGVEHRLMAACNFTRGDSCDLSQRDRGQLSPLLHSTTEWAILPCSFSDLPALSTGLLHLHQNIVDVQYMYGLSPALTKYIVRWEWVVLLFLLLADARVCACIWMLILLGQAEA

SEQ ID NO: 36 - protein, 750 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNTSRCWIPVSPNVAVQQPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIIGGAHWGVMFGLAYFSMQGAWAKVVVILLLAAGVDAQTHTVGGSTAHNARTLTGMFSLGARQKIQLINTNGSWHINRTALNCNDSLHTGFLASLFYTHSFNSSGCPERMSACRSIEAFRVGWGALQYEDNVTNPEDMRPYCWHYPPRQCGVVSASSVCGPVYCFTPSPVVVGTTDRLGAPTYTWGENETDVFLLNSTRPPQGSWFGCTWMNSTGYTKTCGAPPCRIRADFNASMDLLCPTDCFRKHPDTTYIKCGSGPWLTPRCLIDYPYRLWHYPCTVNYTIFKIRMYVGGVEHRLTAACNFTRGDRCNLEDRDRSQLSPLLHSTTEWAILPCTYSDLPALSTGLLHLHQNIVDVQFMYGLSPALTKYIVRWEWVVLLFLLLADARVCACLWMLILLGQAEA

SEQ ID NO: 37 - protein, 750 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEA

SEQ ID NO: 38 - protein, 750 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCVTVPVSAVEVRNISSSYYATNDCSNNSITWQLTDAVLHLPGCVPCENDNGTLHCWIQVTPNVAVKHRGALTRSLRTHVDMIVMAATACSALYVGDVCGAVMILSQAFMVSPQRHNFTQECNCSIYQGHITGHRMAWDMMLSWSPTLTMILAYAARVPELVLEIIFGGHWGVVFGLAYFSMQGAWAKVIAILLLVAGVDATTYSSGQEAGRTVAGFAGLFTTGAKQNLYLINTNGSWHINRTALNCNDSLQTGFLASLFYTHKFNSSGCPERLSSCRGLDDFRIGWGTLEYETNVTNDGDMRPYCWHYPPRPCGIVPARTVCGPVYCFTPSPVVVGTTDKQGVPTYTWGENETDVFLLNSTRPPRGAWFGCTWMNGTGFTKTCGAPPCRIRKDYNSTIDLLCPTDCFRKHPDATYLKCGAGPWLTPRCLVDYPYRLWHYPCTVNFTIFKARMYVGGVEHRFSAACNFTRGDRCRLEDRDRGQQSPLLHSTTEWAVLPCSFSDLPALSTGLLHLHQNIVDVQYLYGLSPALTRYIVKWEWVILLFLLLADARICACLWMLIILGQAEA

SEQ ID NO: 39 - protein, 750 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPHWGPTDPRHRSRNLGKVIDTITCGFADLMGYIPVIGAPVGGVARALAHGVRVLEDGVNYATGNLPGCSFSIFLLALLSCVTVPVSAVEVRNISSSYYATNDCSNNSITWQLENAVLHLPGCVPCENDNGTLRCWTQVTPNVAVKHRGALTQNLRTHVDVIVVAATVCSALYVGDVCGAVMIASQALIVSPARHNFTQECNCSIYQGRITGHHMAWDMMLNWSPTITMILAYAARIPELVLEVIFGGHWGVMFGLAYFSMQGAWAKVIVILLLVAGVDARHHTTGLQAGKTLARVTSLFSIGAKQNIQLINTNGSWHINRTALNCNDSLQTGFIASLFYVNNINSSGCPERMSSCRELDDFRIGWGTLEYETNVTNDEDMRPYCWHYPPKPCGIVPARTVCGPVYCFTPSPIVVGTTDKQGVPTYSWGENETDVFLLNSTRPPRGSWFGCTWMNGTGFTKTCGAPPCRIRRDYNSTLDLLCPTDCFRKHPDTTYLKCGSGPWLTPKCLVEYPYRLWHYPCTVNFTIFKVRMYVGAVEHRFSAACNFTRGDRCRLEDRDRGQQSPLLHSTTEWAVLPCSFSDLPALSTGLLHLHQNIVDVQYLYGLSPAITRYIVKWEWVVLLFLLLADARVCACLWMLIILGQAEA

SEQ ID NO: 40 - protein, 750 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGRVIDTITCGFADLMGYIPVVGAPVGGVARALAHGVRVLEDGINYATGNLPGCSFSIFLLALLSCCTVPVSAVEVRNISTSYYATNDCSNTSITWQLTNAVLHLPGCVPCENDNGTLRCWIQVTPNVAVKHRGALTHNLRTHVDVIVMAATVCSALYVGDICGAVMIVSQAFIISPERHNFTQECNCSMYQGHITGHRMAWDMMLNWSPTLTMILAYAARVPELVLEVIFGGHWGVVFGLAYFSMQGAWAKVIAILLLVAGVDANTYSSGVTVGHTTSTFANIFSVGPSQKINLINTNGSWHINRTALNCNDSLQTGFLASLFYVRNFNSSGCRERLSSCRRLDDFRIGWGTLEYETNVTNDEDMRPYCWHYPPKPCGIVSARTVCGPVYCFTPSPVVVGTTDRQGVPTYSWGENETDVFLLNSTRPPRGAWFGCTWMNGTGFTKTCGAPPCRIRRDYNSTLDLLCPTDCFRKHPDTTYLKCGAGPWLTPKCLVDYPYRLWHYPCTVNFTIFKVRMYVGGVEHRLSAACNFTRGDRCGLEDRDRGQQSPLLHSTTEWAVLPCSFSDLPALSTGLLHLHQNIVDVQYLYGLSPAITRYIVKWEWVVLLFLLLADARVCACLWMLIILGQAEA

SEQ ID NO: 41 - protein, 750 aa, Hepatitis C virus
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPSDPRHRSRNLGRVIDTITCGFADLMGYIPVVGAPVGGVARALAHGVRVLEDGINYATRNLPGCSFSIFLLALLSCVTVPVSSVEIRNISTSYYATNDCSNNSITWQLTNAVLHLPGCVPCENDNGTLRCWIQVTPNVAVKHRGALTHNLRAHVDVIVMAATVCSALYVGDVCGAVMIVSQALIVSPERHNFTQECNCSIYQGHITGQRMAWDMMLNWSPTLTMILAYAARVPELVLEIVFGGHWGVVFGLAYFSMQGAWAKVIAILLLVAGVDATTYSTGATVGRTVGSFAGLFKLGAQQNVQLINTNGSWHINRTALNCNDSLHTGFMAALFYANKFNSSGCPERLSSCRGLDDFRIGWGTLEYETNVTNVEDMRPYCWHYPPKPCGIVPAQSVCGPVYCFTPSPVVVGTTDRQGVPTYNWGDNETDVFLLNSTRPPRGAWFGCTWMNGTGFTKTCGAPPCRIRKDFNSTLDLLCPTDCFRKHPDATYVKCGAGPWLTPRCLIDYPYRLWHYPCTVNFTIFKVRMYVGGVEHRFSAACNFTRGDRCRLEDRDRGQQSPLLHSTTEWAVLPCSFSDLPALSTGLLHLHQNIVDVQYLYGLSPAVTKYIVKWEWVVLLFLLLADARICACLWMLIILGQAEA

SEQ ID NO: 42 - protein, 750 aa, Hepatitis C virus
  misc_feature (203)..(203): Xaa can be any naturally occurring amino acid
  misc_feature (295)..(295): Xaa can be any naturally occurring amino acid
  misc_feature (343)..(343): Xaa can be any naturally occurring amino acid
  misc_feature (401)..(401): Xaa can be any naturally occurring amino acid
  misc_feature (426)..(426): Xaa can be any naturally occurring amino acid
  misc_feature (626)..(626): Xaa can be any naturally occurring amino acid
MSTDPKPQRKTKRNTNRRPQDVKFPGGGQIVGGVYLLPRRGPRLGVRAARKTSERSQPRGRRQPIPKDRRSPGKSWGKPGYPWPLYGNEGCGWAGWLLSPRGSRPTWGPTDPRHRSRNLGKVIDTITCGFADLMGYIPVVGAPVGGVARALAHGVRVLEDGINYATGNLPGCSFSIFLLALLSCLTVPASAVEVRNISSGYYXTNDCSNSSITWQLTNAVLHLPGCVPCENDNGTLRCWIQVTPNVAVKYRGALTHNLRTHVDMIVMAATVCSALYVGDVCGAVMIVSQAFIMSXERHNFTQECNCSIYQGHITGHRMAWDMMLGWSPTLTMILAYAARVPEXVLEVVFGGHWGVVFGLAYFSMQGAWAKVIAILLLVAGVDAGTYSSGATIGQGTRGLVXLFSAGPSQKISLINTNGSWHINRTXLNCNDSLQTGFIASLFYAKSFNSSGCPERLSSCRGLDDFRIGWGTLEYENNVTNDEDMRPYCWHYPPKPCGIVPARTVCGPVYCFTPSPVVVGTTDKQGVPTYSWGENETDVFLLNSTRPPQGAWFGCTWMNGTGFTKTCGAPPCRIRRDHTSTLDLLCPTDCFRKHPDTTYLKCGAGPWLTPKCLVDYPYRLWHYPCTXNFTIFKVRMYVGGVEHRFSAACNFTRGDRCRLEDRDRGQQSPLLHSTTEWAVLPCSFSDLPALSTGLLHLHQNIVDVQYLYGLSPAITKYIVKWEWVILLFLLLADARVCACLWMLIILGQAEA

SEQ ID NO: 43 - protein, 752 aa, Hepatitis C virus
  misc_feature (431)..(431): Xaa can be any naturally occurring amino acid
  misc_feature (466)..(466): Xaa can be any naturally occurring amino acid
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCVPCVQDGNTSTCWTPVTPTVAVRYVGATTASIRSHVDLLVGAATMCSALYVGDMCGAVFLVGQAFTFRPRRHQTVQTCNCSLYPGHLSGHRMAWDMMMNWSPAVGMVVAHVLRLPQTLFDIIAGAHWGILAGLAYYSMQGNWAKVAIIMVMFSGVDATTYTTGGSAARGARGLTSLFSVGAKQKLQLVNTNGSWHINSTALNCNXSINTGFIAGLFYYHKFNSTGCPQRLSSCKPITFFXQGWGPLTDANITGPSDDKPYCWHYAPRPCDVVPASSVCGPVYCFTPSPVVVGTTDAKGVPTYTWGENETDVFLLESLRPPSGRWFGCTWMNSTGFVKTCGAPPCNIYGGGGNPHNESDLFCPTDCFRKHPEATYSRCGAGPWLTPRCMVDYPYRLWHYPCTVNFTLFKVRMFVGGFEHRFTAACNWTRGERCDIEDRDRSEQHPLLHSTTELAILPCSFTPMPALSTGLIHLHQNIVDVQYLYGVGSGMVGWALKWEFVILVFLLLADARVCVALWLMLMISQAEA

SEQ ID NO: 44 - protein, 752 aa, Hepatitis C virus
MSTLPKPQRKTKRNTIRRPQDVKFPGGGQIVGGVYVLPRRGPRLGVRATRKTSERSQPRERRQPIPKARRSDGRSWAQPGYPWPLYGNEGCGWAGWLLSPRGSRPSWGPNDPRRRSRNLGKVIDTLTCGFADLMGYIPIVGAPVGGVARALAHGVRALEDGINFATGNLPGCSFSIFLLALLSCLIHPAASLEWRNTSGLYILTNDCPNSSIVYEADDVILHTPGCIPCVQDGNTSTCWTSVSPTVAVRYVGATTASIRSHVDLLVGAATLCSALYVGDMCGAVFLVGQAFTFRPRRHQTVQTCNCSLYPGHLTGHRMAWDMMMNWSPAVGMVVAHVLRMPQTVFDIIAGAHWGILAGLAYYSMQGNWAKVAIIMVMFSGVDAETHTTGGTAARNAFTLTGLFTQGARQKLELINTNGSWHINRTALNCNESLNTGFIAGLFYLHKFNSTGCPERLSSCKPITFFRQGWGSLTDANITGPSDDKPYCWHYAPRPCEVVPALNVCGPVYCFTPSPVVVGTTDRQGVPTYTWGENETDVFLLRSLRPPSGQWFGCTWMNSTGFVKTCGAPPCDIYGGGGNRCNESDLFCPTDCFRKHPEATYSRCGAGPWLTPRCLVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSGVVGWALRWEFVVLVFLLLADARVCVALWLMLMISQAEA

SEQ ID NO: 45 - protein, 752 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLVHPAASLEWRNTSGLYVLTNDCSNSSIVYEADDVILHTPGCVPCVQDDNTSTCWTPVTPTVAVRYVGATTASIRSHVDLLVGAATLCSALYVGDMCGAVFLVGQAFTFRPRRHQTVQTCNCSLYPGHVSGHRMAWDMMMNWSPAVGMVVAHILRLPQTLFDILAGAHWGILAGLAYYSMQGNWAKVAIVMIMFSGVDAETYVTGGSVAHSARGLTSLFSMGAKQKLQLVNTNGSWHINSTALNCNESINTGFIAGLFYYHKFNSTGCPQRLSSCKPIISFRQGWGPLTDANITGPSDDRPYCWHYAPRPCSVVPASSVCGPVYCFTPSPVVVGTTDIKGKPTYNWGENETDVFLLESLRPPSGRWFGCAWMNSTGFLKTCGAPPCNIYGGEGDPENETDLFCPTDCFRKHPEATYSRCGAGPWLTPRCMVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSDMVGWALKWEFVILVFLLLADARVCVALWLMLMVSQAEA

SEQ ID NO: 46 - protein, 752 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCVPCVQDGNTSTCWTPVTPTVAVRYVGATTASIRSHVDLLVGAATMCSALYVGDMCGAVFLVGQAFTFRPRRHQTVQTCNCSLYPGHLSGHRMAWDMMMNWSPAVGMVVAHVLRLPQTLFDIMAGAHWGILAGLAYYSMQGNWAKVAIIMVMFSGVDAHTYTTGGTASRHTQAFAGLFDIGPQQKLQLVNTNGSWHINSTALNCNESINTGFIAGLFYYHKFNSTGCPQRLSSCKPITFFRQGWGPLTDANITGPSDDRPYCWHYAPRPCDIVPASSVCGPVYCFTPSPVVVGTTDARGVPTYTWGENEKDVFLLKSQRPPSGRWFGCSWMNSTGFLKTCGAPPCNIYGGEGNPHNESDLFCPTDCFRKHPETTYSRCGAGPWLTPRCMVDYPYRLWHYPCTVDFRLFKVRMFVGGFEHRFTAACNWTRGERCDIEDRDRSEQHPLLHSTTELAILPCSFTPMPALSTGLIHLHQNIVDVQYLYGVGSGMVGWALKWEFVILVFLLLADARVCVALWLMLMISQTEA

SEQ ID NO: 47 - protein, 752 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGQNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCVPCVQDGNTSTCWTPVTPTVAVRYVGATTASIRSHVDLLVGAATMCSALYVGDMCGAVFLVGQAFTFRPRRHQTVQTCNCSLYPGHLSGHRMAWDMMMNWSPAVGMVVSHVLRLPQTLFDIIAGAHWGILAGLAYYSMQGNWAKVAVIMVMFSGVDAETYITGGSAAHGVSTLTSLFSSGPQQKLQLVKTNGSWHINSTALNCNESINTGFIAGLFYYHKFNSTGCPQRLSSCKPITFFRQGWGSLTDANVTGASADKPYCWHYAPRPCDVVPALNVCGPVYCFTPSPVVVGTTDRKGVPTYNWGENESDVFLLESLRPPSGRWFGCAWMNSTGFLKTCGAPPCNIYGGGGNPNNESHLFCPTDCFRKHPDATYSRCGAGPWLTPRCMVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSGMVGWALKWEFVILIFLLLADARVCVALWLMLMISQAEA

SEQ ID NO: 48 - protein, 752 aa, Hepatitis C virus
MSTLPKPQRKTKRNTIRRPQDVKFPGGGQIVGGVYVLPRRGPRLGVCATRKTSERSQPRRRRQPIPKARQSGGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCVPCVQNDNISTCWTPVTPTVAVRYVGATTASIRSHVDLLVGAATMCSALYVGDMCGAVFLVGQAFTFRPRRHQTVQTCNCSLYPGHLSGHRMAWDMMMNWFPALGMAVAHVLRVPQTLFDIIAGAHWGILAGLAYYSMQGNWAKVAIIMVMFSGVDAVTYTTGGSAAHATRGLTSLFSVGAQQKLQLVNTNGSWHINSTALNCNESINTGFIAGLFYYHRFNSTGCPQRLSSCKPITFFKQGWGPLTDANISGPSDDKPYCWHYAPRPCKVVPASGVCGPVYCFTPSPVVVGTTDAKGVPTYTWGANDTDVFLLESLRPPGGRWFGCTWMNSTGFVKTCGASPCDIYGGGGNSGNESDLFCPTDCFRKHPEATYSRCGAGPWLTPRCMVDYPYRLWHYPCTVNFTLFKVRMFVGGFEHRFTAACNWTRGERCDIEDRDRSEQHPLLHSTTELAILPCSFTPMPALSTGLIHLHQNIVDVQYLYGVGSGMVGWALKWEFVILIFLLLADRRVCVALWLMLMITQAEA

SEQ ID NO: 49 - protein, 752 aa, Hepatitis C virus
MSTLPKPQRKTKRNTVCRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNVSGLYILTNDCPNSSIVYEADDVILHTPGCIPCVQDGNTSTCWTALTPTVAVRYVGATTASIRSHVDLLVGAATMCSALYVGDMCGAVFLVGQAFTFRPRRHQTVQTCNCSLYPGHLTGHRMAWDMMMNWSPAVGMVVAHVLRLPQTLFDIIAGAHWGILAGLAYYSMQGNWAKVIIIMVMFSGVDATTHVTGGTAGLTAFRLTGLFTVGPQQKLQLVNTNGSWHINRTALNCNDSLNTGFIAGLFRFHKFNSTGCPEMLSSCKPITSFKQGWGPLTDANITIPSDDRPYCWHYPPRSCEVVPALSVCGPVYCFTPSPVVVGTTDAKGVPTYTWGENETDVFLLKSLRPPGGRWFGCTWMNSTGFVQTCGAPPCNIYGGGGDLKNESDLFCPTDCFRKHPEATYSRCGAGPWLTPRCMVDYPYRLWHYPCTVNFTLFKVRMFVGGFEHRFTAACNWTRGERCDIEDRDRSELHPLLHSTTELAILPCSFTPMPALSTGLIHLHQNIVDVQYLYGVGSGMVGWAVKWEFVILVFLLLADARVCVALWLMLMISQAEA

SEQ ID NO: 50 - protein, 752 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLQWRNTSGLYVLTNDCSNSSIVYEADDVILHTPGCVPCVQDGNTSTCWTPVTPTVAVRYVGATTASIRSHVDLLVGAATMCSALYVGDMCGAVFLVGQAFTFRPRRHQTVQTCNCSLYPGHLSGHRMAWDMMMNWSPAAGMVVAHILRLPQTLFDIIAGAHWGILAGLAYYSMQGNWAKVAIIMVMFSGVDATTYTSGGSVAQQARGLADLFSVGAKQNLQLVNTNGSWHINSTALNCDDSINTGFIAGLFYYHKFNSTGCPQRLSDCKPITFFKQGWGPLTDANITGPSDDKPYCWHYAPRRCGVVPASSVCGPVYCFTPSPVVVGTTDAKGVPTYTWGANETDVFLLESLRPPSGRWFGCAWMNSTGFLKTCGAPPCNIYGGGGNPHNESDLFCPTDCFRKHPEATYSRCGAGPWLTPRCMVDYPYRLWHYPCTVNFTLFKMRTFVGGFEHRFTAACNWTRGERCDIEDRDRSEQHPLLHSTTELAILPCSFTPMPALSTGLIHLHQNIVDVQYLYGVGSGMVGWALKWEFVILVFLLLADARVCVALWLMLMISQAEA

SEQ ID NO: 51 - protein, 752 aa, Hepatitis C virus; identical to SEQ ID NO: 50

SEQ ID NO: 52 - protein, 752 aa, Hepatitis C virus
MSTLPKPQRKTKRNTIRRPQDVKFPGGGQIVGGVYVLPRRGPRLGVCATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLVHPAASLEWRNTSGLYVLTNDCPNSSIVYEADDVILHTPGCIPCVQDGNKSTCWTSVTPTVAVKYVGATTASIRSHVDLLVGAATMCSALYVGDMCGAVFLVGQAFTFRPRRHQTVQTCNCSLYPGHLSGHRMAWDMMMNWSPAVGMVVAHVLRLPQTLFDIIAGAHWGILAGLAYYSMQGNWAKVAIIMVMFSGVDATTYTTGGNAARGASGIVSLFTPGAKQNLQLVNTNGSWHINRTALNCNDSINTGFIAGLIYYHKFNSTGCPQRLSSCKPITFFRQGWGSLTDANITGPSDDKPYCWHYPPRPCDTIRASSVCGPVYCFTPSPVVVGTTDAKGAPTYNWGANETDMFLLQSLRPPSGRWFGCTWMNSTGFTKTCGAPPCNIYGGGGNLNNESDLFCPTDCFRKHPEATYSRCGAGPWLTPRCLVDYPYRLWHYPCTVNFTLFRMRTFVGGFEHRFTAACNWTRGERCNIEDRDRSEQHPLLHSTTELAILPCSFTPMPALSTGLIHLHQNIVDVQYLYGIGSGVVGWALKWEFVILVFLLLADARVCVALWLMLMISQAEA

SEQ ID NO: 53 - protein, 752 aa, Hepatitis C virus
MSTLPKPQRKTKRNTIRRPQDVKFPGGGVIYVGVYVLPRRGPRLGVRATRKTSERSQPRGRRKPIPKARRSEGRSWAQPGYPWPLYGNEGCGWAGWLLSPRGSRPNWAPNDPRRRSRNLGKVIDTLTCGFADLMGYIPLVGAPLGGAARALAHGVRALEDGINFATGNLPGCSFSIFLLALFSCLIHPAASLEWRNTSGLYVLTNDCSNSSIVYEADDVILHTPGCIPCVQDGNTSTCWTPVTPTVAVRYVGATTASIRSHVDLLVGAGTMCSALYVGDMCGPVFLVGQAFTFRPRRHRTVQTCNCSLYPGHLSGQRMAWDMMMNWSPAVGMVVAHILRLPQTLFDVVAGAHWGIIAGLAYYSMQGNWAKVAIIMVMFSGVDASTHVTAGQAARNAYGITSLFSVGAKQNLQLINTNGSWHINRTALNCNESINTGFIAGLFYYHKFNSTGCPQRLSSCKPITFFKQGWGPLTDANITGPSDDKPYCWHYAPRPCGIVPALNVCGPVYCFTPSPVVVGTTDAKGAPTYTWGANKTDVFLLESLRPPSGRWFGCTWMNSTGFVKTCGAPPCNIYGDGRDAQNESDLFCPTDCFRKHPEATYSRCGAGPWLTPRCLVDYPYRLWHYPCTVNFTLFKVRMFVGGFEHRFTAACNWTRGERCDIEDRDRSEQHPLLHSTTELAILPCSFTPMPALSTGLIHLHQNIVDVQYLYGIGSGMVGWALKWEFVILIFLLLADARVCVALWLILTISQAEA

SEQ ID NO: 54 - protein, 754 aa, Hepatitis C virus
MSTLPKPKRQTKRNTLRRPKNVKFPAGGQIVGEVYVLPRRGPQLGVREVRKTSERSQPRGRRQPTPKARPREGRSWAQPGYPWPLYGNEGCGWAGWLLPPRGSRPSWGQNDPRRRSRNLGKVIDTLTCGFADLMGYIPLIGAPVGGVARALAHGVRALEDGVNYATGNLPGCSFSIFLLALFSCLTCPASSLEYRNASGLYLLTNDCSNRSIVYEADDVILHLPGCVPCVETDNNNTSCWTPISPTVAVKHPGVTTASIRNHVNMLVAPPTLCSALYVEDAFGAVSLVGQAFTFRPRQHKTVQTCNCSIYPGHVSGHRMAWDMMMNWSPAIGLVISHLMRLPQTFFDLVVGAHWGVMAGLAYFSMQGNWAKVVIVLIMFSGVDATTHTTGGSAAQATAGFTSFFTRGPSQNLQLVNSNGSWHINSTALNCNDSLNTGFIAGLFYYHKFNSSGCPERMSSCKPITYFNQGWGPLTDANINGPSEDRPYCWHYPPRPCNITKPLNVCGPVYCFTPSPVVVGTTDIKGLPTYRFGVNESDVFLLTSLRPPQGRWFGCVWMNSTGFVKTCGAPPCNIYGGMKDIEANQTHLKCPTDCFRKHHDATFTRCGSGPWLTPRCLVDYPYRLWHYPCTVNFSIFKVRMFVGGHEHRFSAACNWTRGERCDLEDRDRSEQQPLLHSTTDSLILPCSFTPMRRLSTGLIHLHQNIVDVQYLYGVGSAVVGWALKWEFVVLVFLLLADARVCVALWMMLLISQAEA

SEQ ID NO: 55 - protein, 750 aa, Hepatitis C virus
MSTNPKPQRLTKRNTVRRPQNVKFPGGGQIVGGVYLLPRRGPRLGVRGTRKSSERSQPRGRRQRIPKAASSQGKAWGKPGYPWPLYGNEGCGWAGWLLSPRGSRPTWGPTDPRHRSRNLGKVIDTMTCGFADLMGYIPVLGAPLGGVARALAHGVRVLEDGVNYATGNLPGCSFSIFLLALLSCLTVPASAYEVRNSSGVYHLTNDCPNASIVYETDNAILHEPGCVPCVREGNTSRCWEPVAPTLAVRYRGALTDDLRTHIDLVVASATLCSALYVGDICGAIFIASQAVLWKPGGGRIVQDCNCSIYPGHVTGHRMAWDMMQNWAPALSMVAAYAVRVPGVIITTVAGGHWGVLFGLAYFGMAGNWAKVILIMLLMSGVDAETMAVGARAAHTTGALVSLLNPGPSQRLQLINTNGSWHINRTALNCNDSLQTGFIAALFYTHRFNSSGCPERMASCKPLSDFDQGWGPLWYNSTERPSDQRPYCWHYAPSPCGIVPAKDVCGPVYCFTPSPVVVGTTDRRGVPTYTWGENESDVFLLNSTRPPQGSWFGCSWMNTTGFTKTCGGPPCKIRPQGAQSNTSLTCPTDCFRKHPRATYSACGSGPWLTPRCMVHYPYRLWHYPCTVNFTIHKVRLYIGGVEHRLDAACNWTRGERCDLEDRDRVDMSPLLHSTTELAILPCSFVPLPALSTGLIHLHQNIVDAQYLYGLSPAIISWAIRWEWVVLVFLLLADARICACLWMMMLMAQAEA

SEQ ID NO: 56 - protein, 5 aa, Artificial Sequence
  Synthetic Sequence
  misc_feature (1)..(5): This stretch of residues may be repeated
GSGGS

SEQ ID NO: 57 - protein, 6 aa, Artificial Sequence
  Synthetic Sequence
  misc_feature (1)..(6): This stretch of residues may be repeated
GGSGGS

SEQ ID NO: 58 - protein, 4 aa, Artificial Sequence
  Synthetic Sequence
  misc_feature (1)..(4): This stretch of residues may be repeated
GGGS

SEQ ID NO: 59 - protein, 4 aa, Artificial Sequence
  Synthetic Sequence
GGSG

SEQ ID NO: 60 - protein, 5 aa, Artificial Sequence
  Synthetic Sequence
GGSGG

SEQ ID NO: 61 - protein, 5 aa, Artificial Sequence
  Synthetic Sequence
GSGSG

SEQ ID NO: 62 - protein, 5 aa, Artificial Sequence
  Synthetic Sequence
GSGGG

SEQ ID NO: 63 - protein, 5 aa, Artificial Sequence
  Synthetic Sequence
GGGSG

SEQ ID NO: 64 - protein, 5 aa, Artificial Sequence
  Synthetic Sequence
GSSSG

SEQ ID NO: 65 - protein, 8 aa, Artificial Sequence
  Synthetic Sequence
LEVLFQGP

SEQ ID NO: 66 - protein, 7 aa, Artificial Sequence
  Synthetic Sequence
ENLYFQS

SEQ ID NO: 67 - protein, 7 aa, Artificial Sequence
  Synthetic Sequence
ENLYFQG

SEQ ID NO: 68 - protein, 6 aa, Artificial Sequence
  Synthetic Sequence
LVPRGS

SEQ ID NO: 69 - protein, 5 aa, Artificial Sequence
  Synthetic Sequence
  misc_feature (2)..(2): Xaa can be E (Glu) or D (Asp)
  misc_feature (5)..(5): Xaa can be any naturally occurring amino acid except R (Arg) or P (Pro)
IXGRX

SEQ ID NO: 70 - protein, 12 aa, Artificial Sequence
  Synthetic Sequence
SSYLKASDAPDN

SEQ ID NO: 71 - protein, 12 aa, Artificial Sequence
  Synthetic Sequence
RPKPQQFFGLMN

SEQ ID NO: 72 - protein, 12 aa, Artificial Sequence
  Synthetic Sequence
SPQGIAGQRNFN

SEQ ID NO: 73 - protein, 14 aa, Artificial Sequence
  Synthetic Sequence
DVDERDVRGFASFL

SEQ ID NO: 74 - protein, 12 aa, Artificial Sequence
  Synthetic Sequence
SKLVQASASGVN

SEQ ID NO: 75 - protein, 5 aa, Artificial Sequence
  Synthetic Sequence
  misc_feature (2)..(2): Xaa is L (Leu) or Q (Gln)
PXGMT

SEQ ID NO: 76 - protein, 6 aa, Artificial Sequence
  Synthetic Sequence
LEVLFQ

SEQ ID NO: 77 - protein, 5 aa, Artificial Sequence
  Synthetic Sequence
DDDDK

SEQ ID NO: 78 - protein, 4 aa, Artificial Sequence
  Synthetic Sequence
LVPR

SEQ ID NO: 79 - protein, 10 aa, Artificial Sequence
  Synthetic Sequence
CGLVPAGSGP

SEQ ID NO: 80 - protein, 12 aa, Artificial Sequence
  Synthetic Sequence
SLLKSRMVPNFN

SEQ ID NO: 81 - protein, 228 aa, Artificial Sequence
  Synthetic Sequence
LHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGFTGDFDSVIDCN

SEQ ID NO: 82 - protein, 12 aa, Artificial Sequence
  Synthetic Sequence
SLLIARRMPNFN

SEQ ID NO: 83 - protein, 17 aa, Artificial Sequence
  Synthetic Sequence
AAAAAAAAAAAAAAAAA

SEQ ID NO: 84 - protein, 17 aa, Artificial Sequence
  Synthetic Sequence
AAAAAAAAAAAAAAAAA

SEQ ID NO: 85 - protein, 17 aa, Artificial Sequence
  Synthetic Sequence
AAAAAAAAAAAAAAAAA

SEQ ID NO: 86 - protein, 17 aa, Artificial Sequence
  Synthetic Sequence
AAAAAAAAAAAAAAAAA

SEQ ID NO: 87 - protein, 17 aa, Artificial Sequence
  Synthetic Sequence
AAAAAAAAAAAAAAAAA

SEQ ID NO: 88 - protein, 17 aa, Artificial Sequence
  Synthetic Sequence
AAAAAAAAAAAAAAAAA

SEQ ID NO: 89 - protein, 171 aa, Artificial Sequence
  Synthetic Sequence
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPG

SEQ ID NO: 90 - protein, 4 aa, Artificial Sequence
  Synthetic Sequence
  misc_feature (2)..(2): Xaa is E (Glu) or D (Asp)
IXGR

SEQ ID NO: 91 - protein, 8 aa, Artificial Sequence
  Synthetic Sequence
DYKDDDDK

SEQ ID NO: 92 - protein, 9 aa, Artificial Sequence
  Synthetic Sequence
YPYDVPDYA

SEQ ID NO: 93 - protein, 10 aa, Artificial Sequence
  Synthetic Sequence
EQKLISEEDL

SEQ ID NO: 94 - protein, 29 aa, Artificial Sequence
  Synthetic Sequence
AIPLEVIKGGRHLIFCHSKKKCDELAAKL

SEQ ID NO: 95 - protein, 52 aa, Artificial Sequence
  Synthetic Sequence
AIPLEVIKGGRHLIFCHSKKKCDELAAKLVALGINAVAYYRGLDVSVIPTSG

SEQ ID NO: 96 - protein, 70 aa, Artificial Sequence
  Synthetic Sequence
KGGRHLIFCHSKKKCDELAAKLVALGINAVAYYRGLDVSVIPTSGDVVVVATDALMTGFTGDFDSVIDCN

SEQ ID NO: 97 - protein, 100 aa, Artificial Sequence
  Synthetic Sequence
VALSTTGEIPFYGKAIPLEVIKGGRHLIFCHSKKKCDELAAKLVALGINAVAYYRGLDVSVIPTSGDVVVVATDALMTGFTGDFDSVIDCNTCVTQTVDF

SEQ ID NO: 98 - protein, 191 aa, Artificial Sequence
  Synthetic Sequence
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASA

SEQ ID NO: 99 - protein, 50 aa, Artificial Sequence
  Synthetic Sequence
LGALTGTYVYNHLTPLRDWAHNGLRDLAVAVEPVVFSQMETKLITWGADT

SEQ ID NO: 100 - protein, 553 aa, Artificial Sequence
  Synthetic Sequence
QASLLKVPYFVRVQGLLRICALARKMAGGHYVQMAIIKLGALTGTYVYNALTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDSRGSLLSPRPISYLKGSAGGPLLCPAGHAVGIFRAAVCTRGVAKAVDFIPVENLETTMRSPVFTDNSSPPAVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGFTGDFDSVIDCN

SEQ ID NO: 101 - protein, 778 aa, Artificial Sequence
  Synthetic Sequence
LHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGFTGDFDSVIDCNTCVTQTVDFSLDPTFTIETTTLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPITKYIMTCMSADLEVVTSTWVLVGGVLAALAAYCLSTGCVVIVGRIVLSGKPAIIPDREVLYREFDEMEECSQHLPYIEQGMMLAEQFKQKALGLLQTASRQAEVIAPAVQTNWQKLEAFWAKHMWNFISGIQYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPG

SEQ ID NO: 102 - protein, 1985 aa, Artificial Sequence
  Synthetic Sequence
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDSRGSLLSPRPISYLKGSAGGPLLCPAGHAVGIFRAAVCTRGVAKAVDFIPVENLETTMRSPVFTDNSSPPAVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGFTGDFDSVIDCNTCVTQTVDFSLDPTFTIETTTLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPITKYIMTCMSADLEVVTSTWVLVGGVLAALAAYCLSTGCVVIVGRIVLSGKPAIIPDREVLYREFDEMEECSQHLPYIEQGMMLAEQFKQKALGLLQTASRQAEVIAPAVQTNWQKLEAFWAKHMWNFISGIQYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPDAELIEANLLWRQEMGGNITRVESENKVVILDSFDPLVAEEDEREISVPAEILRKSRRFAPALPIWARPDYNPPLLETWKKPDYEPPVVHGCPLPPPQSPPVPPPRKKRTVVLTESTVSTALAELATKSFGSSSTSGITGDNTTTSSEPAPSGCPPDSDAESYSSMPPLEGEPGDPDLSDGSWSTVSSEADTEDVVCCSMSYSWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVNHINSVWKDLLEDSVTPIDTTIMAKNEVFCVQPEKGGRKPARLIVFPDLGVRVCEKMALYDVVSKLPLAVMGSSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKARAACRAAGLQDCTMLVCGNNLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWRHRARSVRARLLSRGGRAAICGKYLFNWAVRTKLKLTPIAAAGQLDLSGWFTAGYSGGDIYHSVSHARPRWFWFCLLLLAAGVGIYLLPNR

SEQ ID NO: 103 - protein, 14 aa, Artificial Sequence
  Synthetic Sequence
QYIKANSKFIGIFE

SEQ ID NO: 104 - protein, 14 aa, Artificial Sequence
  Synthetic Sequence
QYIKANSKFIGITE

SEQ ID NO: 105 - protein, 124 aa, Artificial Sequence
  Synthetic Sequence
MIKLKFGVFFTVLLSSAYAHGTPQNITDLCAEYHNTQIHTLNDKIFSYTESLAGKREMAIITFKNGATFQVEVPGSQHIDSQKKAIERMKDTLRIAYLTEAKVEKLCVWNNKTPHAIAAISMAN

SEQ ID NO: 106 - protein, 15 aa, Artificial Sequence
  Synthetic Sequence
ILMQYIKANSKFIGI

SEQ ID NO: 107 - protein, 7 aa, Artificial Sequence
  Synthetic Sequence
VNNESSE

SEQ ID NO: 108 - protein, 17 aa, Artificial Sequence
  Synthetic Sequence
PGINGKAIHLVNNESSE

SEQ ID NO: 109 - protein, 6 aa, Artificial Sequence
  Synthetic Sequence
PNRDIL

SEQ ID NO: 110 - protein, 7 aa, Artificial Sequence
  Synthetic Sequence
FIGITEL

SEQ ID NO: 111 - protein, 6 aa, Artificial Sequence
  Synthetic Sequence
SYFPSV

SEQ ID NO: 112 - protein, 20 aa, Artificial Sequence
  Synthetic Sequence
NSVDDALINSTKIYSYFPSV

SEQ ID NO: 113 - protein, 20 aa, Artificial Sequence
  Synthetic Sequence
IDKISDVSTIVPYIGPALNI

SEQ ID NO: 114 - protein, 15 aa, Artificial Sequence
  Synthetic Sequence
QSIALSSLMVAQAIP

SEQ ID NO: 115 - protein, 19 aa, Artificial Sequence
  Synthetic Sequence
PVFAGANYAAWAVNVAQVI

SEQ ID NO: 116 - protein, 20 aa, Artificial Sequence
  Synthetic Sequence
VHHNTEEIVAQSIALSSLMV

SEQ ID NO: 117 - protein, 20 aa, Artificial Sequence
  Synthetic Sequence
QSIALSSLMVAQAIPLVGEL

SEQ ID NO: 118 - protein, 20 aa, Artificial Sequence
  Synthetic Sequence
VDIGFAAYNFVESIINLFQV

SEQ ID NO: 119 - protein, 20 aa, Artificial Sequence
  Synthetic Sequence
QGESGHDIKITAENTPLPIA

SEQ ID NO: 120 - protein, 20 aa, Artificial Sequence
  Synthetic Sequence
GVLLPTIPGKLDVNKSKTHI

SEQ ID NO: 121 - protein, 534 aa, Artificial Sequence
  Synthetic Sequence
ADDVVDSSKSFVMENFSSYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKS

SEQ ID NO: 122 - protein, 26 aa, Artificial Sequence
  Synthetic Sequence
IMQYIKANSKFIGIQSIALSSLMVAQ

SEQ ID NO: 123 - DNA, 24 bp, Artificial Sequence
  Synthetic Sequence
tcgtcgttttgtcgttttgtcgtt

SEQ ID NO: 124 - protein, 12 aa, Artificial Sequence
  Synthetic Sequence
SLPLGLWAPNFN

SEQ ID NO: 125 - protein, 6 aa, Artificial Sequence
  Synthetic Sequence
  misc_feature (2)..(2): Xaa can be L (Lue) or Q (Gln)
PXGMTS

SEQ ID NO: 126 - protein, 7 aa, Artificial Sequence
  Synthetic Sequence
ENLYTQS

SEQ ID NO: 127 - protein, 12 aa, Artificial Sequence
  Synthetic Sequence
SLRPLALWRSFN

SEQ ID NO: 128 - protein, 12 aa, Artificial Sequence
  Synthetic Sequence
SLLIFRSWANFN

SEQ ID NO: 129 - protein, 12 aa, Artificial Sequence
  Synthetic Sequence
SGVVIATVIVIT

SEQ ID NO: 130 - protein, 12 aa, Artificial Sequence
  Synthetic Sequence
SLGPQGIWGQFN

SEQ ID NO: 131 - protein, 12 aa, Artificial Sequence
  Synthetic Sequence
KKSPGRVVGGSV

SEQ ID NO: 132 - protein, 12 aa, Artificial Sequence
  Synthetic Sequence
PQGLLGAPGILG

SEQ ID NO: 133 - protein, 31 aa, Artificial Sequence
  Synthetic Sequence
HGPEGLRVGFYESDVMGRGHARLVHVEEPHT

SEQ ID NO: 134 - protein, 12 aa, Artificial Sequence
  Synthetic Sequence
GPQGLAGQRGIV

SEQ ID NO: 135 - protein, 12 aa, Artificial Sequence
  Synthetic Sequence
GGSGQRGRKALE

SEQ ID NO: 136 - protein, 12 aa, Artificial Sequence
  Synthetic Sequence
SLSALLSSDIFN

SEQ ID NO: 137 - protein, 12 aa, Artificial Sequence
  Synthetic Sequence
SLPRFKIIGGFN

SEQ ID NO: 138 - protein, 12 aa, Artificial Sequence
  Synthetic Sequence
SLLGIAVPGNFN

SEQ ID NO: 139 - protein, 12 aa, Artificial Sequence
  Synthetic Sequence
FFKNIVTPRTPP

SEQ ID NO: 140 - protein, 227 aa, Homo sapiens
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 141 - protein, 325 aa, Homo sapiens
STKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 142 - protein, 246 aa, Homo sapiens
HKPSNTKVDKRVELKTPLGDTTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 143 - protein, 383 aa, Homo sapiens
PTKAPDVFPIISGCRHPKDNSPVVLACLITGYHPTSVTVTWYMGTQSQPQRTFPEIQRRDSYYMTSSQLSTPLQQWRQGEYKCVVQHTASKSKKEIFRWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPRSTTFWAWSVLRVPAPPSPQPATYTCVVSHEDSRTLLNASRSLEVSYVTDHGPMK

SEQ ID NO: 144 - protein, 276 aa, Homo sapiens
VTSTLTIKZSDWLGESMFTCRVDHRGLTFQQNASSMCVPDQDTAIRVFAIPPSFASIFLTKSTKLTCLVTDLTTYBSVTISWTREENGAVKTHTNISESHPNATFSAVGEASICEDBDWSGERFTCTVTHTDLPSPLKQTISRPKGVALHRPBVYLLPPARZZLNLRESATITCLVTGFSPADVFVEWMQRGEPLSPQKYVTSAPMPEPQAPGRYFAHSILTVSEEEWNTGGTYTCVVAHEALPNRVTERTVDKSTGKPTLYNVSLVMSDTAGTCY

SEQ ID NO: 145 - protein, 353 aa, Homo sapiens
ASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCPVPSTPPTPSPSTPPTPSPSCCHPRLSLHRPALEDLLLGSEANLTCTLTGLRDASGVTFTWTPSSGKSAVQGPPERDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 146 - protein, 222 aa, Homo sapiens
ADPCDSNPRGVSAYLSRPSPFDLFIRKSPTITCLVVDLAPSKGTVNLTWSRASGKPVNHSTRKEEKQRNGTLTVTSTLPVGTRDWIEGETYQCRVTHPHLPRALMRSTTKTSGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPGK

SEQ ID NO: 147 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 148 - protein, 15 aa, Artificial Sequence
  Synthetic Sequence
VLVLNPSVAATLGFG

SEQ ID NO: 149 - protein, 15 aa, Artificial Sequence
  Synthetic Sequence
TYGKFLADGGCSGGA

SEQ ID NO: 150 - protein, 15 aa, Artificial Sequence
  Synthetic Sequence
GGRHLIFCHSKKKCD

SEQ ID NO: 151 - protein, 11 aa, Artificial Sequence
  Synthetic Sequence
VAYYRGLDVSV

SEQ ID NO: 152 - protein, 18 aa, Artificial Sequence
  Synthetic Sequence
ATDALMTGFTGDFDSVID

SEQ ID NO: 153 - protein, 15 aa, Artificial Sequence
  Synthetic Sequence
TGLTHIDAHFLSQTK

SEQ ID NO: 154 - protein, 13 aa, Artificial Sequence
  Synthetic Sequence
QYLAGLSTLPGNP

SEQ ID NO: 155 - protein, 8 aa, Artificial Sequence
  Synthetic Sequence
NLLPAILS

SEQ ID NO: 156 - protein, 27 aa, Artificial Sequence
  Synthetic Sequence
RHVGPGEGAVQWMNRLIAFASRGNHVS

SEQ ID NO: 157 - protein, 15 aa, Artificial Sequence
  Synthetic Sequence
SSASQLSAPSLKATC

SEQ ID NO: 158 - protein, 5 aa, Artificial Sequence
  Synthetic Sequence
SNVSV

SEQ ID NO: 159 - protein, 9 aa, Artificial Sequence
  Synthetic Sequence
TYSTYGKFL

SEQ ID NO: 160 - protein, 9 aa, Artificial Sequence
  Synthetic Sequence
LIFCHSKKK

SEQ ID NO: 161 - protein, 16 aa, Artificial Sequence
  Synthetic Sequence
ATDALMTGFTGDFDSV

SEQ ID NO: 162 - protein, 10 aa, Artificial Sequence
  Synthetic Sequence
VLAALAAYCL

SEQ ID NO: 163 - protein, 9 aa, Artificial Sequence
  Synthetic Sequence
ILAGYGAGV

SEQ ID NO: 164 - protein, 8 aa, Artificial Sequence
  Synthetic Sequence
IPFYGKAI

SEQ ID NO: 165 - protein, 9 aa, Artificial Sequence
  Synthetic Sequence
RAQAPPPSW

SEQ ID NO: 166 - protein, 36 aa, Artificial Sequence
  Synthetic Sequence
EGAVQWMNRLIAFASRGNHVSPTHYVPESDAAARVT

SEQ ID NO: 167 - protein, 9 aa, Artificial Sequence
  Synthetic Sequence
RPDYNPPLL

SEQ ID NO: 168 - protein, 9 aa, Artificial Sequence
  Synthetic Sequence
TIMAKNEVF

SEQ ID NO: 169 - protein, 3014 aa, Artificial sequence
  Synthetic Sequence
  misc_feature (197)..(197): Xaa can be any naturally occurring amino acid
  misc_feature (241)..(241): Xaa can be any naturally occurring amino acid
  misc_feature (251)..(251): Xaa can be any naturally occurring amino acid
  misc_feature (290)..(290): Xaa can be any naturally occurring amino acid
  misc_feature (331)..(331): Xaa can be any naturally occurring amino acid
  misc_feature (334)..(334): Xaa can be any naturally occurring amino acid
  misc_feature (343)..(344): Xaa can be any naturally occurring amino acid
  misc_feature (372)..(372): Xaa can be any naturally occurring amino acid
  misc_feature (390)..(390): Xaa can be any naturally occurring amino acid
  misc_feature (407)..(407): Xaa can be any naturally occurring amino acid
  misc_feature (433)..(433): Xaa can be any naturally occurring amino acid
  misc_feature (476)..(476): Xaa can be any naturally occurring amino acid
  misc_feature (523)..(523): Xaa can be any naturally occurring amino acid
  misc_feature (597)..(597): Xaa can be any naturally occurring amino acid
  misc_feature (715)..(715): Xaa can be any naturally occurring amino acid
  misc_feature (767)..(767): Xaa can be any naturally occurring amino acid
  misc_feature (786)..(786): Xaa can be any naturally occurring amino acid
  misc_feature (792)..(792): Xaa can be any naturally occurring amino acid
  misc_feature (821)..(821): Xaa can be any naturally occurring amino acid
  misc_feature (826)..(826): Xaa can be any naturally occurring amino acid
  misc_feature (843)..(843): Xaa can be any naturally occurring amino acid
  misc_feature (857)..(857): Xaa can be any naturally occurring amino acid
  misc_feature (873)..(874): Xaa can be any naturally occurring amino acid
  misc_feature (884)..(884): Xaa can be any naturally occurring amino acid
  misc_feature (922)..(922): Xaa can be any naturally occurring amino acid
  misc_feature (928)..(928): Xaa can be any naturally occurring amino acid
  misc_feature (955)..(955): Xaa can be any naturally occurring amino acid
  misc_feature (1020)..(1020): Xaa can be any naturally occurring amino acid
  misc_feature (1099)..(1099): Xaa can be any naturally occurring amino acid
  misc_feature (1143)..(1143): Xaa can be any naturally occurring amino acid
  misc_feature (1161)..(1161): Xaa can be any naturally occurring amino acid
  misc_feature (1210)..(1210): Xaa can be any naturally occurring amino acid
  misc_feature (1223)..(1223): Xaa can be any naturally occurring amino acid
  misc_feature (1371)..(1371): Xaa can be any naturally occurring amino acid
  misc_feature (1385)..(1385): Xaa can be any naturally occurring amino acid
  misc_feature (1409)..(1409): Xaa can be any naturally occurring amino acid
  misc_feature (1599)..(1599): Xaa can be any naturally occurring amino acid
  misc_feature (1607)..(1607): Xaa can be any naturally occurring amino acid
  misc_feature (1695)..(1695): Xaa can be any naturally occurring amino acid
  misc_feature (1753)..(1753): Xaa can be any naturally occurring amino acid
  misc_feature (1874)..(1874): Xaa can be any naturally occurring amino acid
  misc_feature (2071)..(2072): Xaa can be any naturally occurring amino acid
  misc_feature (2074)..(2074): Xaa can be any naturally occurring amino acid
  misc_feature (2087)..(2087): Xaa can be any naturally occurring amino acid
  misc_feature (2106)..(2106): Xaa can be any naturally occurring amino acid
  misc_feature (2134)..(2134): Xaa can be any naturally occurring amino acid
  misc_feature (2279)..(2279): Xaa can be any naturally occurring amino acid
  misc_feature (2321)..(2321): Xaa can be any naturally occurring amino acid
  misc_feature (2335)..(2335): Xaa can be any naturally occurring amino acid
  misc_feature (2358)..(2358): Xaa can be any naturally occurring amino acid
  misc_feature (2361)..(2362): Xaa can be any naturally occurring amino acid
  misc_feature (2364)..(2364): Xaa can be any naturally occurring amino acid
  misc_feature (2367)..(2367): Xaa can be any naturally occurring amino acid
  misc_feature (2373)..(2374): Xaa can be any naturally occurring amino acid
  misc_feature (2376)..(2376): Xaa can be any naturally occurring amino acid
  misc_feature (2383)..(2383): Xaa can be any naturally occurring amino acid
  misc_feature (2487)..(2487): Xaa can be any naturally occurring amino acid
  misc_feature (2496)..(2496): Xaa can be any naturally occurring amino acid
  misc_feature (2542)..(2542): Xaa can be any naturally occurring amino acid
  misc_feature (2546)..(2546): Xaa can be any naturally occurring amino acid
  misc_feature (2572)..(2572): Xaa can be any naturally occurring amino acid
  misc_feature (2601)..(2601): Xaa can be any naturally occurring amino acid
  misc_feature (2653)..(2653): Xaa can be any naturally occurring amino acid
  misc_feature (2660)..(2660): Xaa can be any naturally occurring amino acid
  misc_feature (2676)..(2676): Xaa can be any naturally occurring amino acid
  misc_feature (2689)..(2689): Xaa can be any naturally occurring amino acid
  misc_feature (2695)..(2695): Xaa can be any naturally occurring amino acid
  misc_feature (2722)..(2722): Xaa can be any naturally occurring amino acid
  misc_feature (2757)..(2757): Xaa can be any naturally occurring amino acid
  misc_feature (2798)..(2798): Xaa can be any naturally occurring amino acid
  misc_feature (2857)..(2857): Xaa can be any naturally occurring amino acid
  misc_feature (2863)..(2863): Xaa can be any naturally occurring amino acid
  misc_feature (2966)..(2966): Xaa can be any naturally occurring amino acid
  misc_feature (3002)..(3002): Xaa can be any naturally occurring amino acid
  misc_feature (3014)..(3014): Xaa can be any naturally occurring amino acid
MSTNPKPQRKTKRNTNRRPQDVKFPGGGQIVGGVYLLPRRGPRLGVRATRKTSERSQPRGRRQPIPKARRSEGRSWAQPGYPWPLYGNEGCGWAGWLLSPRGSRPSWGPTDPRRRSRNLGKVIDTLTCGFADLMGYIPLVGAPLGGVARALAHGVRVLEDGINYATGNLPGCSFSIFLLALLSCLTVPASAYEVRNXSGLYHVTNDCPNSSIVYEADDAILHTPGCVPCVREGNTSRCWVXVTPTVAVRYXGAPTTSLRRHVDLLVGAATLCSALYVGDLCGAVFLVGQXFTFSPRRHWTVQDCNCSIYPGHITGHRMAWDMMMNWSPTTXLVXAQLLRIPQXXLDIIAGAHWGVLAGLAYFSMQGNWAKVXVLLLFAGVDAETHTTGGXAARTTSGLTSLFSPGPXQNLQLINTNGSWHINRTALNCNDSLXTGFIAGLFYTHKFNSSGCPERLASCRPLTDFDQGWGPLTYANXISGPSDDRPYCWHYPPRPCGIVPARSVCGPVYCFTPSPVVVGTTDRXGVPTYTWGENETDVFLLNSTRPPQGNWFGCTWMNSTGFTKTCGAPPCNIGGGGNNDLLCPTDCFRKHPEATYSXCGSGPWLTPRCLVDYPYRLWHYPCTVNFTIFKVRMYVGGVEHRLEAACNWTRGERCDLEDRDRSELSPLLHSTTEWAILPCSFTTLPALSTGLIHLHQNIVDVQYLYGVGSAVVSWAXKWEYVVLLFLLLADARVCACLWMMLLISQAEAALENLVVLNAASAAGTHGIXWFLVFFCAAWYLKGRLVPXATYALXGLWPLLLLLLALPQRAYALDREVAASLGXAVLVXLTIFTLSPHYKHLLSRXLWWLQYFITRAEAXLQVWVPPLNVRGGRDXXILLTCLLHPXLVFDITKLLLAVLGPLYLLQASLLRVPYFVRAHALLRXCMLVRXLAGGKYVQMALLKLGRWTGTYIYDHLXPLSDWAAAGLRDLAVAVEPVIFSPMEKKVITWGADTAACGDILCGLPVSARLGREILLGPADDYXSKGWRLLAPITAYAQQTRGLLGTIVTSLTGRDKNEVEGEVQVLSTATQTFLGTCINGVMWTVYHGAGSKTLAGPKGPVXQMYTNVDQDLVGWPAPPGAKSLTPCTCGSSDLYLVTRHADVIPXRRRGDSRGSLLSPRPISXLKGSSGGPVLCPSGHAVGIFRAAVCTRGVAKAVDFIPVESLETTMRSPXFTDNSTPPAVPQXYQVGYLHAPTGSGKSTKVPAAYAAQGYKVLVLNPSVAATLGFGAYMSKAHGIDPNIRTGVRTVTTGAPITYSTYGKFLADGGCSGGAYDIIICDECHSTDATTILGIGTVLDQAETAGVRLVVLATATPPGSVTVPHPNIEEVALGTXGEIPFYGKAIPLEXIKGGRHLIFCHSKKKCDELAAKLXGLGLNAVAYYRGLDVSVIPTSGDVVVVATDALMTGFTGDFDSVIDCNVAVTQTVDFSLDPTFTIETTTVPQDAVSRSQRRGRTGRGRLGIYRYVSPGERPSGMFDSVVLCECYDAGCAWYELTPAETTVRLRAYLNTPGLPVCQDHLEFWEGVFTGLTHIDAHFLSQTKQSGENFPYLVAYQATVCARAXAPPPSWDXMWKCLIRLKPTLHGPTPLLYRLGAVQNEVTLTHPITKYIMTCMSADLEVVTSTWVLVGGVLAALAAYCLSTGCVVIVGRIVLSGKPAXIPDREVLYQQFDEMEECSQHLPYIEQGQQIAEQFKQKALGLLQTATKQAEVIAPAVQXNWQKLEQFWAKHMWNFISGIQYLAGLSTLPGNPAVASLMAFTAAVTSPLTTSQTLLFNILGGWVASQLAPPTAATAFVVSGLAGAAVGSIGLGKVLVDILAGYGAGVAGALVAFKIMSGEXPSTEDLVNLLPAILSPGALVVGVVCAAILRRHVGPGEGAVQWMNRLIAFASRGNHVSPTHYVPESDAAARVTQILSSLTVTSLLRRLHQWINEDCSTPCSGSWLRDIWDWVCTVLSDFKTWLKAKLLPQLPGIPFLSCQRGYKGVWRGDGVMHTRCPCGAEITGHVKNGSMRIVGPKTCSNTWHGTFPINAYTTGPXXPXPAPNYKRALWRVXAEEYVEVRRVGDFHYVTGXTTDNLKCPCQVPAPEFFTEVDGVRLHRXAPPCKPLLRDEVTFSVGLNSYVVGSQLPCEPEPDVAVLTSMLTDPSHITAETAARRLARGSPPSLASSSASQLSAPSLKATCTTHHDHPDAELIEANLLWRQEMGGNITRVESENKVVILDSFDPLVAEEDDREISVPAECLRKXRKFPPALPIWARPDYNPPLLETWKRPDYEPPTVHGCALPPPXAPPVPPPRRKRTVXLTESTVSTALAELAEKSFGSSEXSGXXSXSGXDTTSSXXSXPPDCDAXSDAESYSSMPPLEGEPGDPDLSDGSWSTVSDEEDSVVCCSMSYSWTGALITPCAAEEEKLPINPLSNSLLRHHNLVYSTTSRSASQRQKKVTFDRLQVLDDHYXDVLKEVKAXASKVKARLLSVEEACALTPPHSARSKFGYGAKDVRSLSRKAVNHIXSVWXDLLEDSTTPIPTTIMAKNEVFCVDPXKGGRKPARLIVYPDLGVRVCEKRALYDVXQKLPKAVMGSSYGFQYSPAQRVEFLLKAWKSKKTPMGFSYDTRCFDSTVTEXDIRTEEXIYQCCDLDPEARKAIXSLTERLYVGGPMXNSKGQXCGYRRCRASGVLTTSMGNTLTCYIKAXAACRAAGLRDCTMLVCGDDLVVICESAGVZEDAAXLRAFTEAMTRYSAPPGDPPQPEYDLELITSCSSNVSVAHDXSGKRVYYLTRDPTTPLARAAWETARHTPVNSWLGNIIMYAPTIWVRMVLMTHFFSILQXQEQLEXALDFEMYGATYSVTPLDLPAIIQRLHGLSAFSLHSYSPGELNRVAACLRKLGVPPLRAWRHRARAVRAKLIAQGGRAAICGKYLFNWAVRTKLKLTPLPAAGXLDLSSWFTVGAGGGDIYHSVSRARPRWLLLCLLLLXVGVGIFLLPARX

SEQ ID NO: 170 - protein, 3012 aa, Artificial sequence
  Synthetic Sequence
  misc_feature (3012)..(3012): Xaa can be any naturally occurring amino acid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTTALVVAQLLRIPQAILDMIAGAHWGVLAGIAYFSMVGNWAKVLVVLLLFAGVDAETHVTGGSAARTTSGLASLFTPGAKQNIQLINTNGSWHINRTALNCNDSLNTGWLAGLFYYHKFNSSGCPERLASCRPLTDFDQGWGPISYANGSGPDQRPYCWHYPPKPCGIVPAKSVCGPVYCFTPSPVVVGTTDRSGAPTYNWGENDTDVFVLNNTRPPLGNWFGCTWMNSTGFTKVCGAPPCVIGGVGNNTLHCPTDCFRKHPEATYSRCGSGPWITPRCLVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEAALENLVVLNAASLAGTHGLVSFLVFFCFAWYLKGRWVPGAAYALYGMWPLLLLLLALPQRAYALDTEVAASCGGVVLVGLMALTLSPYYKRYISWCLWWLQYFLTRVEAQLHVWVPPLNVRGGRDAVILLMCVVHPTLVFDITKLLLAVFGPLWILQASLLKVPYFVRVQGLLRICALARKMAGGHYVQMAIIKLGALTGTYVYNHLTPLRDWAHNGLRDLAVAVEPVVFSQMETKLITWGADTAACGDIINGLPVSARRGREILLGPADGMVSKGWRLLAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDSRGSLLSPRPISYLKGSSGGPLLCPAGHAVGIFRAAVCTRGVAKAVDFIPVENLETTMRSPVFTDNSSPPAVPQSFQVAHLHAPTGSGKSTKVPAAYAAQGYKVLVLNPSVAATLGFGAYMSKAHGIDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGFTGDFDSVIDCNTCVTQTVDFSLDPTFTIETTTLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPITKYIMTCMSADLEVVTSTWVLVGGVLAALAAYCLSTGCVVIVGRIVLSGKPAIIPDREVLYREFDEMEECSQHLPYIEQGMMLAEQFKQKALGLLQTASRQAEVIAPAVQTNWQKLEAFWAKHMWNFISGIQYLAGLSTLPGNPAIASLMAFTAAVTSPLTTSQTLLFNILGGWVAAQLAAPGAATAFVGAGLAGAAIGSVGLGKVLVDILAGYGAGVAGALVAFKIMSGEVPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPCTPLPAPNYTFALWRVSAEEYVEIRQVGDFHYVTGMTTDNLKCPCQVPSPEFFTELDGVRLHRFAPPCKPLLREEVSFRVGLHEYPVGSQLPCEPEPDVAVLTSMLTDPSHITAEAAGRRLARGSPPSVASSSASQLSAPSLKATCTANHDSPDAELIEANLLWRQEMGGNITRVESENKVVILDSFDPLVAEEDEREISVPAEILRKSRRFAPALPIWARPDYNPPLLETWKKPDYEPPVVHGCPLPPPQSPPVPPPRKKRTVVLTESTVSTALAELATKSFGSSSTSGITGDNTTTSSEPAPSGCPPDSDAESYSSMPPLEGEPGDPDLSDGSWSTVSSEADTEDVVCCSMSYSWTGALVTPCAAEEQKLPINALSNSLLRHHNLVYSTTSRSACQRQKKVTFDRLQVLDSHYQDVLKEVKAAASKVKANLLSVEEACSLTPPHSAKSKFGYGAKDVRCHARKAVNHINSVWKDLLEDSVTPIDTTIMAKNEVFCVQPEKGGRKPARLIVFPDLGVRVCEKMALYDVVSKLPLAVMGSSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKARAACRAAGLQDCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMILMTHFFSVLIARDQLEQALDCEIYGACYSIEPLDLPPIIQRLHGLSAFSLHSYSPGEINRVAACLRKLGVPPLRAWRHRARSVRARLLSRGGRAAICGKYLFNWAVRTKLKLTPIAAAGQLDLSGWFTAGYSGGDIYHSVSHARPRWFWFCLLLLAAGVGIYLLPNRX

SEQ ID NO: 171 - protein, 3008 aa, Artificial sequence
  Synthetic Sequence
  misc_feature (3008)..(3008): Xaa can be any naturally occurring amino acid
MSTNPKPQRKTKRNTNRRPQDVKFPGGGQIVGGVYLLPRRGPRLGVRATRKTSERSQPRGRRQPIPKARRPEGRAWAQPGYPWPLYGNEGMGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGVYHVTNDCSNSSIVYEAADMIMHTPGCVPCVRENNSSRCWVALTPTLAARNASVPTTTIRRHVDLLVGAAAFCSAMYVGDLCGSVFLVSQLFTFSPRRHETVQDCNCSIYPGHVSGHRMAWDMMMNWSPTTALVVSQLLRIPQAVVDMVAGAHWGVLAGLAYYSMVGNWAKVLIVMLLFAGVDGTHVTGGAAARTTSGFTSLFSPGPSQKIQLINTNGSWHINRTALNCNDSLQTGFLAALFYTHKFNSSGCPERMASCRPIDKFAQGWGPITYAEPSSDQRPYCWHYAPRPCGIVPASQVCGPVYCFTPSPVVVGTTDRFGVPTYSWGENETDVLLLNNTRPPQGNWFGCTWMNSTGFTKTCGGPPCNIGGVGNNTLTCPTDCFRKHPEATYTKCGSGPWLTPRCLVDYPYRLWHYPCTVNFTIFKVRMYVGGVEHRLNAACNWTRGERCDLEDRDRSELSPLLLSTTEWQILPCSFTTLPALSTGLIHLHQNIVDVQYLYGIGSAVVSFAIKWEYVLLLFLLLADARVCACLWMMLLIAQAEAALENLVVLNAASVAGAHGILSFLVFFCAAWYIKGRLVPGAAYAFYGVWPLLLLLLALPPRAYAMDREMAASCGGAVFVGLALLTLSPHYKVFLARLIWWLQYFITRAEAHLQVWIPPLNVRGGRDAIILLTCAVHPELIFDITKLLLAILGPLMVLQAGITRVPYFVRAQGLIRACMLVRKVAGGHYVQMAFMKLAALTGTYVYDHLTPLRDWAHAGLRDLAVAVEPVVFSDMETKIITWGADTAACGDIILGLPVSARRGREILLGPADSLEGQGWRLLAPITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSSGGPLLCPSGHAVGIFRAAVCTRGVAKAVDFVPVESMETTMRSPVFTDNSSPPAVPQTFQVAHLHAPTGSGKSTKVPAAYAAQGYKVLVLNPSVAATLGFGAYMSKAHGVDPNIRTGVRTITTGAPITYSTYGKFLADGGCSGGAYDIIICDECHSTDSTTILGIGTVLDQAETAGARLVVLATATPPGSVTVPHPNIEEVALSNTGEIPFYGKAIPIETIKGGRHLIFCHSKKKCDELAAKLSGLGLNAVAYYRGLDVSVIPTSGDVVVVATDALMTGFTGDFDSVIDCNTCVTQTVDFSLDPTFTIETTTVPQDAVSRSQRRGRTGRGRRGIYRFVTPGERPSGMFDSSVLCECYDAGCAWYELTPAETSVRLRAYLNTPGLPVCQDHLEFWESVFTGLTHIDAHFLSQTKQAGDNFPYLVAYQATVCARAQAPPPSWDQMWKCLIRLKPTLHGPTPLLYRLGAVQNEVTLTHPITKYIMACMSADLEVVTSTWVLVGGVLAALAAYCLTTGSVVIVGRIILSGKPAIIPDREVLYQEFDEMEECASHLPYIEQGMQLAEQFKQKALGLLQTATKQAEAAAPVVESKWRALEFWAKHMWNFISGIQYLAGLSTLPGNPAIASLMAFTASITSPLTTQHTLLFNILGGWVAAQLAPPSAASAFVGAGIAGAAVGSIGLGKVLVDILAGYGAGVAGALVAFKVMSGEMPSTEDLVNLLPAILSPGALVVGVVCAAILRRHVGPGEGAVQWMNRLIAFASRGNHVSPTHYVPESDAAARVTQILSSLTITQLLKRLHQWINEDCSTPCSGSWLRDVWDWICTVLTDFKTWLQSKLLPRLPGVPFLSCQRGYKGVWRGDGIMQTTCPCGAQITGHVKNGSMRIVGPKTCSNTWHGTFPINAYTTGPCTPSPAPNYSRALWRVAAEEYVEVTRVGDFHYVTGMTTDNVKCPCQVPAPEFFTEVDGVRLHRYAPACKPLLREEVTFQVGLNQYLVGSQLPCEPEPDVAVLTSMLTDPSHITAETAKRRLARGSPPSLASSSASQLSAPSLKATCTTRHDSPDADLIEANLLWRQEMGGNITRVESENKVVILDSFDPLRAEEDEREVSVPAEILRKSRKFPPAMPIWARPDYNPPLLESWKDPDYVPPVVHGCPLPPTKAPPIPPPRRKRTVVLTESTVSSALAELATKTFGSSESSAVDSGTATAPPDQPSDDGDAGSDVESYSSMPPLEGEPGDPDLSDGSWSTVSEEASEDVVCCSMSYTWTGALITPCAAEESKLPINALSNSLLRHHNMVYATTSRSASQRQKKVTFDRLQVLDDHYRDVLKEMKAKASTVKAKLLSVEEACKLTPPHSARSKFGYGAKDVRNLSSKAVNHIRSVWKDLLEDTETPIDTTIMAKNEVFCVQPEKGGRKPARLIVFPDLGVRVCEKMALYDVVSTLPQAVMGSSYGFQYSPGQRVEFLVNAWKSKKCPMGFAYDTRCFDSTVTESDIRVEESIYQCCDLAPEARQAIRSLTERLYIGGPLTNSKGQNCGYRRCRASGVLTTSCGNTLTCYLKASAACRAAKLQDCTMLVCGDDLVVICESAGTQEDAASLRVFTEAMTRYSAPPGDPPQPEYDLELITSCSSNVSVAHDASGKRVYYLTRDPTTPLARAAWETARHTPVNSWLGNIIMYAPTLWARMILMTHFFSILLAQEQLEKALDCQIYGACYSIEPLDLPQIIQRLHGLSAFSLHSYSPGEINRVASCLRKLGVPPLRVWRHRARSVRAKLLSQGGRAATCGKYLFNWAVRTKLKLTPIPAASQLDLSGWFVAGYSGGDIYHSLSRARPRWFMWCLLLLSVGVGIYLLPNRX

SEQ ID NO: 172 - protein, 3034 aa, Artificial sequence
  Synthetic Sequence
  misc_feature (250)..(250): Xaa can be any naturally occurring amino acid
  misc_feature (406)..(406): Xaa can be any naturally occurring amino acid
  misc_feature (408)..(409): Xaa can be any naturally occurring amino acid
  misc_feature (3023)..(3023): Xaa can be any naturally occurring amino acid
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPTDPRHRSRNVGKVIDTLTCGFADLMGYIPVVGAPLGGVARALAHGVRVLEDGVNYATGNLPGCSFSIFLLALLSCITVPVSAAQVKNTSSSYMVTNDCSNDSITWQLQAAVLHVPGCVPCEKVGNNTSRCWIPVSPNVAVXQPGALTQGLRTHIDMVVMSATLCSALYVGDLCGGVMLAAQMFIVSPQHHWFVQECNCSIYPGTITGHRMAWDMMMNWSPTATMILAYAMRVPEVIIDIISGAHWGVMFGLAYFSMQGAWAKVVVILLLAAGVDAGTHTVGGSAAHTTSGLAGLFSXGXXQNIQLINTNGSWHINRTALNCNDSLNTGFLASLFYTHRFNSSGCPERLSACRNIEAFRIGWGTLQYEDNVTNPEDMRPYCWHYPPKQCGIVPARSVCGPVYCFTPSPVVVGTTDRLGVPTYTWGENETDVFLLNSTRPPQGSWFGCTWMNSTGFTKTCGAPPCRIRADFNASTDLLCPTDCFRKHPEATYIKCGSGPWLTPRCLVDYPYRLWHYPCTVNYTIFKIRMYVGGVEHRLTAACNFTRGDRCNLEDRDRSQLSPLLHSTTEWAILPCSYSDLPALSTGLLHLHQNIVDVQYMYGLSPALTKYVVRWEWVVLLFLLLADARVCACLWMLILLGQAEAALEKLVVLHAASAASCNGFLYFVIFFVAAWYIKGRAVPLAAYSLTGLWPFCLLLLALPQQAYAYDASVHGQIGAALLILITLFTLTPGYKTLLSRCLWWLCYLLTLGEAMVQEWAPPMQARGGRDGIIWAATIFCPGVVFDITKWLLAVLGPAYLLRDALTRVPYFVRAHALLRMCTMVRHLAGGRYVQMALLALGRWTGTYIYDHLTPMSDWAASGLRDLAVAVEPIIFSPMEKKVIVWGAETAACGDILHGLPVSARLGREILLGPADGYTSKGWRLLAPITAYAQQTRGLLGAIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGIFRAAVCSRGVAKSIDFIPVETLDIVTRSPTFSDNSTPPAVPQTYQVGYLHAPTGSGKSTKVPVAYAAQGYKVLVLNPSVAATLGFGAYLSKAHGINPNIRTGVRTVTTGEAITYSTYGKFLADGGCAGGAYDIIICDECHAVDATTILGIGTVLDQAETAGVRLTVLATATPPGSVTTPHPNIEEVALGQEGEIPFYGRAIPLSYIKGGRHLIFCHSKKKCDELAAALRGMGLNAVAYYRGLDVSIIPTQGDVVVVATDALMTGYTGDFDSVIDCNVAVTQVVDFSLDPTFTITTQTVPQDAVSRSQRRGRTGRGRLGIYRYVSTGERASGMFDSVVLCECYDAGAAWYELTPAETTVRLRAYFNTPGLPVCQDHLEFWEAVFTGLTHIDAHFLSQTKQSGENFAYLVAYQATVCARAKAPPPSWDVMWKCLTRLKPTLVGPTPLLYRLGSVTNEVTLTHPVTKYIATCMQADLEVMTSTWVLAGGVLAAVAAYCLATGCVSIIGRLHINQRAVVAPDKEVLYEAFDEMEECASRAALIEEGQRIAEMLKSKIQGLLQQASKQAQDIQPAVQASWPKVEQFWAKHMWNFISGIQYLAGLSTLPGNPAVASMMAFSAALTSPLSTSTTILLNILGGWLASQIAPPAGATGFVVSGLVGAAVGSIGLGKVLVDILAGYGAGISGALVAFKIMSGEKPSMEDVVNLLPGILSPGALVVGVICAAILRRHVGPGEGAVQWMNRLIAFASRGNHVAPTHYVTESDASQRVTQLLGSLTITSLLRRLHNWITEDCPIPCAGSWLRDVWDWVCTILTDFKNWLTSKLFPKMPGLPFISCQKGYKGVWAGTGIMTTRCPCGANISGNVRLGSMRITGPKTCMNTWQGTFPINCYTEGQCVPKPAPNFKTAIWRVAASEYAEVTQHGSYSYITGLTTDNLKVPCQLPSPEFFSWVDGVQIHRFAPTPKPFFRDEVSFCVGLNSFVVGSQLPCDPEPDTDVLMSMLTDPSHITAEAAARRLARGSPPSEASSSASQLSAPSLRATCTTHGKTYDVDMVDANLFMGGDVTRIESESKVVVLDSLDPMAEERSDLEPSIPSEYMLPRNRFPPALPAWARPDYNPPLVESWKRPDYQPPTVAGCALPPPKKTPTPPPRRRRTVGLSESTIGDALQQLAIKTFGQPPPSGDSGLSTGADAADSGGRTPPDELALSETGSISSMPPLEGEPGDPDLEPEQVELQPPPQGGEVAPGSDSGSWSTCSEEDDSVVCCSMSYSWTGALITPCSPEEEKLPINPLSNSLLRYHNKVYCTTSKSASLRAKKVTFDRMQVLDAHYDSVLKDIKLAASKVSARLLTLEEACQLTPPHSARSKYGFGAKEVRSLSGRAVNHIKSVWKDLLEDSQTPIPTTIMAKNEVFCVDPTKGGKKAARLIVYPDLGVRVCEKMALYDVTQKLPQAVMGASYGFQYSPAQRVEFLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPQGRRRYYLTRDPTTPIARAAWETVRHSPVNSWLGNIIQYAPTIWVRMVLMTHFFSILMAQDTLDQNLNFEMYGSVYSVSPLDLPAIIERLHGLDAFSLHTYTPHELTRVASALRKLGAPPLRAWKSRARAVRASLISRGGRAAVCGRYLFNWAVKTKLKLTPLPEARLLDLSSWFTVGAGGGDIYHSVSRARPRLLLLSLLLLXVGVGLFLLPAR

SEQ ID NO: 173 - protein, 3033 aa, Artificial sequence
  Synthetic Sequence
MSTNPKPQRKTKRNTNRRPQDVKFPGGGQIVGGVYLLPRRGPRLGVRATRKTSERSQPRGRRQPIPKDRRSTGKSWGKPGYPWPLYGNEGCGWAGWLLSPRGSRPTWGPTDPRHRSRNLGKVIDTITCGFADLMGYIPVVGAPVGGVARALAHGVRVLEDGINYATGNLPGCSFSIFLLALLSCVTVPVSAVEVRNISSSYYATNDCSNNSITWQLTNAVLHLPGCVPCENDNGTLRCWIQVTPNVAVKHRGALTHNLRTHVDMIVMAATVCSALYVGDVCGAVMIVSQALIVSPERHNFTQECNCSIYQGHITGHRMAWDMMLNWSPTLTMILAYAARVPELVLEVVFGGHWGVVFGLAYFSMQGAWAKVIAILLLVAGVDATTYSSGAQAGRTTSGFAGLFSPGPKQNIQLINTNGSWHINRTALNCNDSLQTGFIASLFYTNNFNSSGCPERLSSCRGLDDFRIGWGTLEYETNVTNDEDMRPYCWHYPPKPCGIVSARTVCGPVYCFTPSPVVVGTTDRQGVPTYSWGENETDVFLLNSTRPPQGAWFGCTWMNGTGFTKTCGAPPCRIRRDYNSTLDLLCPTDCFRKHPDATYLKCGAGPWLTPRCLVDYPYRLWHYPCTVNFTIFKVRMYVGGVEHRLSAACNFTRGDRCRLEDRDRGQQSPLLHSTTEWAVLPCSFSDLPALSTGLLHLHQNIVDVQYLYGLSPAITRYIVKWEWVVLLFLLLADARVCACLWMLIILGQAEAALEKLIILHSASAASANGPLWFFIFFTAAWYLKGRVVPVATYSVLGLWSFLLLVLALPQQAYALDAAEQGELGLVILVIISIFTLTPAYKILLSRSVWWLSYMLVLAEAQIQQWVPPLEARGGRDGIIWVAVILHPRLVFEVTKWLLAILGPAYLLKASLLRVPYFVRAHALLRVCTLVRHLAGARYIQMLLITIGRWTGTYIYDHLSPLSTWAAQGLRDLAVAVEPVVFSPMEKKVIVWGAETVACGDILHGLPVSARLGREVLLGPADSYTSKGWKLLAPITAYTQQTRGLLGAIVVSLTGRDKNEQAGQVQVLSSVTQSFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCPRGHAVGLFRAAVCARGVAKSIDFIPVESLDIATRTPSFSDNSTPPAVPQSYQVGYLHAPTGSGKSTKVPAAYASQGYKVLVLNPSVAATLGFGAYMSKAHGINPNIRTGVRTVTTGDPITYSTYGKFLADGGCSAGAYDVIICDECHSVDATTILGIGTVLDQAETAGARLVVLATATPPGTVTTPHSNIEEVALGHEGEIPFYGKAIPLAFIKGGRHLIFCHSKKKCDELAAALRGMGVNAVAYYRGLDVSVIPTQGDVVVVATDALMTGYTGDFDSVIDCNVAVTQIVDFSLDPTFTITTQTVPQDAVSRSQRRGRTGRGRLGIYRYVSSGERPSGMFDSVVLCECYDAGAAWYELTPAETTVRLRAYFNTPGLPVCQDHLEFWEAVFTGLTHIDAHFLSQTKQGGDNFAYLTAYQATVCARAKAPPPSWDVMWKCLTRLKPTLTGPTPLLYRLGAVTNEVTLTHPVTKYIATCMQADLEIMTSTWVLAGGVLAAVAAYCLATGCISIIGRLHLNDQVVVAPDKEILYEAFDEMEECASKAALIEEGQRMAEMLKSKIQGLLQQATRQAQDIQPAIQSSWPKLEQFWAKHMWNFISGIQYLAGLSTLPGNPAVASMMAFSAALTSPLPTSTTILLNIMGGWLASQIAPPAGATGFVVSGLVGAAVGSIGLGKILVDVLAGYGAGISGALVAFKIMSGEKPSVEDVVNLLPAILSPGALVVGVICAAILRRHVGQGEGAVQWMNRLIAFASRGNHVAPTHYVAESDASQRVTQVLSSLTITSLLRRLHAWITEDCPVPCSGSWLRDIWDWVCSILTDFKNWLSSKLLPKMPGLPFISCQKGYRGVWAGTGVMTTRCPCGANISGHVRMGTMKITGPKTCLNLWQGTFPINCYTEGPCVPKPPPNYKTAIWRVAASEYVEVTQHGSFSYVTGLTSDNLKVPCQVPAPEFFSWVDGVQIHRFAPTPGPFFRDEVTFTVGLNSFVVGSQLPCDPEPDTEVLASMLTDPSHITAEAAARRLARGSPPSQASSSASQLSAPSLKATCTTHKMAYDCDMVDANLFMGGDVTRIESDSKVIVLDSLDSMTEVEDDREPSVPSEYLIRRRKFPPALPPWARPDYNPPVIETWKRPGYEPPTVLGCALPPTPQAPVPPPRRRRAKVLTQDNVEGVLREMADKVLSPLQDHNDSGHSTGADTGGDSVQQPSDETAASEAGSLSSMPPLEGEPGDPDLEFEPAGSAPPSEGECEVIDSDSKSWSTVSDQEDSVICCSMSYSWTGALITPCGPEEEKLPINPLSNSLMRFHNKVYSTTSRSASLRAKKVTFDRVQVLDAHYDSVLQDVKRAASKVSARLLSVEEACALTPPHSAKSRYGFGAKEVRSLSRRAVNHIRSVWEDLLEDQHTPIDTTIMAKNEVFCVDPTKGGKKPARLIVYPDLGVRVCEKMALYDIAQKLPKAIMGPSYGFQYSPAERVDFLLKAWGSKKDPMGFSYDTRCFDSTVTERDIRTEESIYQACSLPQEARTVIHSLTERLYVGGPMTNSKGQSCGYRRCRASGVFTTSMGNTMTCYIKALAACKAAGIVDPIMLVCGDDLVVISESQGNEEDERNLRAFTEAMTRYSAPPGDLPRPEYDLELITSCSSNVSVALDSRGRRRYFLTRDPTTPITRAAWETVRHSPVNSWLGNIIQYAPTIWVRMVIMTHFFSILLAQDTLNQNLNFEMYGAVYSVNPLDLPAIIERLHGLDAFSLHTYSPHELSRVAATLRKLGAPPLRAWKSRARAVRASLIAQGGRAAICGRYLFNWAVKTKLKLTPLPEASRLDLSGWFTVGAGGGDIFHSVSHARPRLLLLCLLLLSVGVGIFLLPAR

SEQ ID NO: 174 - protein, 3068 aa, Artificial sequence
  Synthetic Sequence
  misc_feature (385)..(385): Xaa can be any naturally occurring amino acid
  misc_feature (409)..(409): Xaa can be any naturally occurring amino acid
  misc_feature (585)..(585): Xaa can be any naturally occurring amino acid
  misc_feature (3048)..(3048): Xaa can be any naturally occurring amino acid
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCIPCVQTDGNTSTCWTPVTPTVAVKYVGATTASIRSHVDLLVGAATMCSALYVGDMCGAVFLVGQAFTFRPRRHQTVQTCNCSLYPGHLSGHRMAWDMMMNWSPAVGMVVAHVLRLPQTLFDIIAGAHWGILAGLAYYSMQGNWAKVAIIMVMFSGVDAXTHTTGGSAARGARGLTSLFSVGPXQNLQLVNTNGSWHINRTALNCNDSINTGFIAGLFYYHKFNSTGCPQRLSSCKPITFFRQGWGPLTDANNITGPSDDKPYCWHYAPRPCDVVPASSVCGPVYCFTPHHSPVVVGTTDAKGVPTYTWGENETDVFLLESLRPPSGRWFGCTWMNSTRGFVKTCGAPPCNIYGGGGNPXNNESDLFCPTDCFRKHPEATYSRCGAGPWLTPRCMVDYPYRLWHYPCTVNFTLFKVRMFVGGFEHRFTAACNWTRGERCDIEDRDRSEQHPLLHSTTELAILPCSFTPMPALSTGLIHLHQNIVDVQYLYGVGSGMVGWALKWEFVILVFLLLADARVCVALWLMLMISQAEAALENLVTLNAVAAAGTHGIGWYLVAFCAAWHVRRAGKLVPLVTYSLTGLWSLALLVLLLPQRAYAWSGEDSATLGAGILVLFGFFTLSPWYKHWIGRLMWWNQYTICRCEAALQVWVPPLLARGSRDGVILLTSLLYPSLIFDITKLLIAVLGPLYLIQAAITTTPYFVRAHVLVRLCMLVRSVMGGKYFQMIILSIGRWFNTYLYDHLAPMQHWAAAGLKDLAVATEPVIFSPMEIKVITWGADTAACGDILCGLPVSARLGREVLLGPADDYREMGWRLLAPITAYAQQTRGLLGTIVTSLTGRDKNVVTGEVQVLSTATQTFLGTTVGGVMWTVYHGAGSRTLAGAKHPALQMYTNVDQDLVGWPAPPGAKSLEPCACGSADLYLVTRDADVIPARRRGDSTASLLSPRPLACLKGSSGGPVMCPSGHVAGIFRAAVCTRGVAKALQFIPVETLSTQARSPSFSDNSTPPAVPQSYQVGYLHAPTGSGKSTKVPAAYVAQGYNVLVLNPSVAATLGFGSFMSRAYGIDPNIRTGNRTVTTGAKLTYSTYGKFLADGGCSGGAYDVIICDECHAQDATSILGIGTVLDQAETAGVRLTVLATATPPGSITVPHSNIEEVALGSEGEIPFYGKAIPIAQLKGGRHLIFCHSKKKCDEIASKLRGMGLNAVAYYRGLDVSVIPTTGDVVVCATDALMTGFTGDFDSVIDCNVAVEQYVDFSLDPTFSIETRTAPQDAVSRSQRRGRTGRGRLGTYRYVTPGERPSGMFDSVVLCECYDAGCSWYDLQPAETTVRLRAYLSTPGLPVCQDHLDFWESVFTGLTHIDAHFLSQTKQQGLNFSYLTAYQATVCARAQAPPPSWDETWKCLVRLKPTLHGPTPLLYRLGPVQNEICLTHPITKYIMACMSADLEVTTSTWSTWVLLGGVLAALAAYCLSVGCVVIVGHIELGGKPALVPDKEVLYQQYDEMEECSQAAPYIEQAQVIAHQFKEKVLGLLQRATQQQAVIEPIVATNWQKLEAFWHKHMWNFVSGIQYLAGLSTLPGNPAVASLMAFTASVTSPLTTNQTMFFNILGGWVATHLAGPQSSSAFVVSGLAGAAIGGIGLGRVLLDILAGYGAGVSGALVAFKIMGGELPTAEDMVNLLPAILSPGALVVGVICAAILRRHVGPGEGAVQWMNRLIAFASRGNHVSPTHYVPESDAAARVTALLSSLTVTSLLRRLHQWINEDYPSPCSGDWLRTIWDWVCTVLSDFKTWLSAKIMPALPGLPFISCQKGYKGVWRGDGVMSTRCPCGASITGHVKNGSMRLAGPRTCANMWHGTFPINEYTTGPSTPCPSPNYTRALWRVAANSYVEVRRVGDFHYITGATEDELKCPCQVPAAEFFTEVDGVRLHRYAPPCKPLLRDEITFMVGLNSYAIGSQLPCEPEPDVSVLTSMLRDPSHITAETAARRLARGSPPSEASSSASQLSAPSLKATCQTHRPHPDAELVDANLLWRQEMGSNITRVESETKVVILDSFEPLRAETDDAELSVAAECFKKPPKYPPALPIWARPDYNPPLLDRWKAPDYVPPTVHGCALPPRGAPPVPPPRRKRTIQLDGSNVSAALAALAEKSFPSSKPQEENSSSSGVDTQSSTTSKVPPSPGGESDSESCSSMPPLEGEPGDPDLSCDQVELQPPPQGGGVAPGSGSGSWSTVSDSEEQSVVCCSMSYSWTGALITPCSAEEEKLPISPLSNSLLRHHNLVYSTSSRSASQRQKKVTFDRLQVLDDHYKTALKEVKERASRVKARMLTIEEACALVPPHSARSKFGYSAKDVRSLSSKAINQIRSVWEDLLEDTTTPIPTTIMAKNEVFCVDPAKGGRKPARLIVYPDLGVRVCEKRALYDVIQKLSIETMGSAYGFQYSPQQRVERLLKMWTSKKTPLGVLFSYDTRCFDSTVTGEQDIRVEEEIYQCCNLEPEARKVISSLTERLYCGGPMFNSKGAQCGYRRCRASGVLPTSFGNTITCYIKATAAARAAGLRNPDFLVCGDDLVVVAESDGVDEDRAALRAFTEAMTRLWTRYYSAPPGDAPHRPTLQPTYDLELITSCSSNVSVARDNKGKRYYYLTRDATTPLARAAWETARHTPGWGVNSWLGNIIMYAPTIWVRMVMMTHFFSILQSQEILDRPLDFEMYGATYSVTPLDLPAIIERLHGLSAFTLHSYSPVELNRVAGTLRKLGCPPLRAWRHRARAVRAKLIAQGGKAKICGLYLFNWAVRTKTKLTPLPAAGQLDLSSWFTVGVGGNDIYHSVSRARTRXLLLCLLLLTVGVGIFLLPAR

SEQ ID NO: 175 - protein, 3035 aa, Artificial sequence
  Synthetic Sequence
  misc_feature (232)..(232): Xaa can be any naturally occurring amino acid
  misc_feature (397)..(397): Xaa can be any naturally occurring amino acid
  misc_feature (407)..(407): Xaa can be any naturally occurring amino acid
  misc_feature (678)..(678): Xaa can be any naturally occurring amino acid
  misc_feature (1002)..(1002): Xaa can be any naturally occurring amino acid
MSTNPKPQRKTKRNTNRRPMDVKFPGGGQIVGGVYLLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRAVEDGINYATGNLPGCSFSIFLLALLSCLTVPASAINYRNTSGIYHVTNDCPNSSIVYEADHHILHLPGCVPCVRXGNQSRCWVALTPTVAAPYIGAPLESLRSHVDLMVGAATVCSALYIGDLCGGLFLVGQMFSFRPRRHWTTQDCNCSIYTGHITGHRMAWDMMMNWSPTTTLVLAQVMRIPSTLVDLLAGGHWGVLVGVAYFSMQANWAKVILVLFLFAGVDAETHVSGGAAGRTTXGLTSLFSPGXQQNLQLINSNGSWHINRTALNCNDSLNTGFLASLFYTHKFNSSGCPERLASCKSLDSFDQGWGPLGVANNISGPSDDRPYCWHYPPRPCGIVPASSVCGPVYCFTPSPVVVGTTDRLGVPTYTWGENESDVFLLNSTRPPQGAWFGCVWMNSTGFTKACGAPPCEVRTNNGTSTDWPCPTDCFRKHPETTYAKCGSGPWITPRCLIHYPYRLWHYPCTVNFTVFKIRTFIGGIEHRMEAACNWTRGEVCGLEHRDRAELSPLLLSTTTWQXLPCSFTTLPALSTGLIHLHQNIVDVQYLYGVGSAVVSWALKWEYVVLAFLLLADARVSACLWMMFMVSQVEAALSNLININAASAAGTHGFWYAIFFICIAWHVKGRLPAAATYAACGMWPLLLLLLMLPERAYAYDREVAGSLGGAVVVALTILTLSPHYKSWLARGLWWIQYFIARAEALLHVYVPSFDVRGPRDSLIILAVLACPHLVFDITKYLLAILGPLYILQASLLRVPYFVRAHALVKICSLLRGVVYGKYCQMAVLKVGALTGTYIYDHLTPLSDWAAEGLRDLAVALEPVVFTPMEKKVIVWGADTAACGDIIXGLPVSARLGNEILLGPADSETSKGWRLLAPITAYAQQTRGLFSTIITSLTGRDTNENCGEVQVLSTATQSFLGTAVNGVMWTVYHGAGSKTISGPKGPVNQMYTNVDQDLVGWPAPPGVKSLAPCTCGASDLYLVTRHADVVPVRRRGDTRGALLSPRPISTLKGSSGGPLLCPMGHAAGIFRAAVCTRGVAKAVDFVPVESLETTMRSPVFTDNSTPPAVPQTYQVAHLHAPTGSGKSTKVPAAYAAQGYKVLVLNPSVAATLGFGAYMSKAYGIDPNIRSGVRTITTGAPITYSTYGKFLADGGCSGGAYDIIICDECHSTDSTTILGIGTVLDQAETAGVRLVVLATATPPGSVTTPHSNIEEVALPTTGEIPFYGKAIPLELIKGGRHLIFCHSKKKCDELAKQLTSLGLNAVAYYRGLDVSVIPTSGDVVVCATDALMTGFTGDFDSVIDCNTSVIQTVDFSLDPTFSIETTTVPQDAVSRSQRRGRTGRGRLGIYRYVTPGERPSGIFDTSVLCECYDAGCAWYELTPAETTTRLRAYFNTPGLPVCQDHLEFWESVFTGLTQIDGHFLSQTKQSGENFPYLVAYQATVCARALAPPPSWDTMWKCLIRLKPTLHGPTPLLYRLGSVQNEVTLTHPITKYIMACMSADLEVVTSTWVLVGGVLAALAAYCLSVGSVVIVGRVVLSGQPAVIPDREVLYQQFDEMEECSKHLPLVEHGLQLAEQFKQKAVGLLNFAGKQAQEATPVIQSNFAKLEQFWAKHMWNFISGIQYLAGLSTLPGNPAIASLMSFTAAVTSPLTTQQTLLFNILGGWVASQIATPTASTAFVVSGLAGAAVGSVGLGKILVDILAGYGAGVAGAVVTFKIMSGEMPSTEDLVNLLPAILSPGALVVGVVCAAILRRHVGPGEGAVQWMNRLIAFASRGNHVSPTHYVPESDAAARVTQILSSLTVTSLLRRLHKWINEDCSTPCAESWLWEVWDWVCTVLSDFKTWLKAKLLPLMPGIPFLSCQRGYKGEWRGDGVMHTTCPCGAELAGHIKNGSMRITGPKTCSNTWHGTFPINAYTTGPGVPIPAPNYKFALWRVSAEEYVEVRRVGDFHYVTGVTQDNIKCPCQVPAPEFFTEVDGIRLHRHAPKCKPLLRDEVSFSVGLNSFVVGSQLPCEPEPDVAVLTSMLTDPSHITAETASRRLARGSPPSLASSSASQLSAPSLKATCTARHDSPGTDLLEANLLWGSTATRVETDEKVIILDSFEPCVAEPDDDREVSVAAEILRPTKKFPPALPIWARPDYNPPLTETWKQQDYKPPTVHGCALPPSKQPPVPPPRRKRTVQLTESVVSTALAELAAKTFGQSELGSDSGADLTTGPTETTDSGPILVDDASDDGSYSSMPPLEGEPGDPDLTSDQVELQPPPQGGGVAPGSGSGSWSTVSGSEDTVVCCSMSYSWTGALVTPCAAEESKLPISPLSNSLLRHHNMVYATTTRSAVTRQKKVTFDRLQVVDNHYNETLKEIKARASRVKARLLTTEEACDLTPPHSAKSKFGYGAKDVRSHSRKAINHINSVWEDLLEDNNTPIPTTIMAKNEVFAVNPAKGGRKPARLIVYPDLGGVRVCEKRALHDVINQLPKAVMGAAYGFQYSPAQRVEFLLTSWKSKKTPMGFSYDTRCFDSTVTEKDIRTEEEVYQCCDLEPEARKVITALTERLYVGGPMHNSKGDLCGYRRCRASGVYTTSFGNTLTCYLKATAAIKAAGLRDCTMLVCGDDLVVIAESDGVEEDNRALRAFTEAMTRYSAPPGDAPQPAYDLELITSCSSNVSVAHDATGKKVYYLTRDPETPLARAAWETVRHTPVNSWLGNIIVYAPTIWVRMVLMTHFFSILQSQEALEKALDFDMYGVTYSITPLDLPAIIQRLHGLSAFTLHGYSPHELNRVAGSLRKLGVPPLRAWRHRARAVRAKLIAQGGKAKICGIYLFNWAVKTKLKLTPLPAAANLDLSSWFTVGAGGGDIYHSVSRARPRYLLLCLLLLSVGVGIFLLPAR

SEQ ID NO: 176 - protein, 3013 aa, Artificial sequence
  Synthetic Sequence
  misc_feature (178)..(178): Xaa can be any naturally occurring amino acid
  misc_feature (189)..(189): Xaa can be any naturally occurring amino acid
  misc_feature (232)..(232): Xaa can be any naturally occurring amino acid
  misc_feature (251)..(251): Xaa can be any naturally occurring amino acid
  misc_feature (257)..(257): Xaa can be any naturally occurring amino acid
  misc_feature (285)..(285): Xaa can be any naturally occurring amino acid
  misc_feature (297)..(297): Xaa can be any naturally occurring amino acid
  misc_feature (300)..(300): Xaa can be any naturally occurring amino acid
  misc_feature (333)..(333): Xaa can be any naturally occurring amino acid
  misc_feature (365)..(365): Xaa can be any naturally occurring amino acid
  misc_feature (384)..(384): Xaa can be any naturally occurring amino acid
  misc_feature (386)..(386): Xaa can be any naturally occurring amino acid
  misc_feature (391)..(391): Xaa can be any naturally occurring amino acid
  misc_feature (396)..(398): Xaa can be any naturally occurring amino acid
  misc_feature (404)..(404): Xaa can be any naturally occurring amino acid
  misc_feature (442)..(442): Xaa can be any naturally occurring amino acid
  misc_feature (444)..(444): Xaa can be any naturally occurring amino acid
  misc_feature (476)..(476): Xaa can be any naturally occurring amino acid
  misc_feature (502)..(502): Xaa can be any naturally occurring amino acid
  misc_feature (523)..(523): Xaa can be any naturally occurring amino acid
  misc_feature (525)..(525): Xaa can be any naturally occurring amino acid
  misc_feature (529)..(529): Xaa can be any naturally occurring amino acid
  misc_feature (532)..(532): Xaa can be any naturally occurring amino acid
  misc_feature (547)..(547): Xaa can be any naturally occurring amino acid
  misc_feature (723)..(723): Xaa can be any naturally occurring amino acid
  misc_feature (742)..(742): Xaa can be any naturally occurring amino acid
  misc_feature (763)..(763): Xaa can be any naturally occurring amino acid
  misc_feature (773)..(773): Xaa can be any naturally occurring amino acid
  misc_feature (775)..(775): Xaa can be any naturally occurring amino acid
  misc_feature (779)..(779): Xaa can be any naturally occurring amino acid
  misc_feature (794)..(794): Xaa can be any naturally occurring amino acid
  misc_feature (825)..(825): Xaa can be any naturally occurring amino acid
  misc_feature (839)..(839): Xaa can be any naturally occurring amino acid
  misc_feature (844)..(844): Xaa can be any naturally occurring amino acid
  misc_feature (857)..(857): Xaa can be any naturally occurring amino acid
  misc_feature (905)..(905): Xaa can be any naturally occurring amino acid
  misc_feature (908)..(908): Xaa can be any naturally occurring amino acid
  misc_feature (914)..(914): Xaa can be any naturally occurring amino acid
  misc_feature (931)..(931): Xaa can be any naturally occurring amino acid
  misc_feature (1020)..(1021): Xaa can be any naturally occurring amino acid
  misc_feature (1088)..(1088): Xaa can be any naturally occurring amino acid
  misc_feature (1114)..(1114): Xaa can be any naturally occurring amino acid
  misc_feature (1118)..(1118): Xaa can be any naturally occurring amino acid
  misc_feature (1384)..(1384): Xaa can be any naturally occurring amino acid
  misc_feature (1613)..(1613): Xaa can be any naturally occurring amino acid
  misc_feature (1756)..(1756): Xaa can be any naturally occurring amino acid
  misc_feature (2262)..(2262): Xaa can be any naturally occurring amino acid
  misc_feature (2356)..(2356): Xaa can be any naturally occurring amino acid
  misc_feature (2374)..(2374): Xaa can be any naturally occurring amino acid
  misc_feature (2385)..(2385): Xaa can be any naturally occurring amino acid
  misc_feature (2540)..(2540): Xaa can be any naturally occurring amino acid
  misc_feature (2601)..(2601): Xaa can be any naturally occurring amino acid
  misc_feature (2636)..(2636): Xaa can be any naturally occurring amino acid
  misc_feature (2674)..(2674): Xaa can be any naturally occurring amino acid
  misc_feature (2994)..(2994): Xaa can be any naturally occurring amino acid
  misc_feature (3002)..(3002): Xaa can be any naturally occurring amino acid
MSTNPKPQRKTKRNTNRRPQDVKFPGGGQIVGGVYLLPRRGPRLGVRATRKTSERSQPRGRRQPIPKARRPTGRSWGQPGYPWPLYANEGLGWAGWLLSPRGSRPNWGPNDPRRKSRNLGKVIDTLTCGFADLMGYIPLVGGPVGGVARALAHGVRVLEDGINYATGNLPGCSFSIFXLALLSCLTVPXSAVPYRNASGVYHVTNDCPNSSIVYEAENLILHAPGCVPCVRXGNVSRCWVQITPTLSAPSXGAVTAXLRRAVDYLAGGAALCSALYVGDACGAVXLVGQMFTYSPRXHTXVQDCNCSIYSGHITGHRMAWDMMMNWSPTTALXMAQLLRIPQVVIDIIAGAHWGVLFAAAYFASXANWAKVILVLFLFAGVDAXTXTVGGXAGQGXXXLTSFFXPGPQQNLQLINTNGSWHINRTALNCNDSLQTGFIAGLXYXHKFNSSGCPQRMASCRPLAAFDQGWGTISYAXVSGPSDDKPYCWHYPPRPCGVVPARXVCGPVYCFTPSPVVVGTTDRXGXPTYXWGXNETDIFLLNNTRPPXGNWFGCTWMNSTGFVKTCGAPPCNLGPTGNNSLKCPTDCFRKHPDATYTKCGSGPWLTPRCLVHYPYRLWHYPCTVNYTIFKVRMFIGGLEHRLEAACNWTRGERCDLEDRDRAELSPLLHTTTQWAILPCSFTPTPALSTGLIHLHQNIVDTQYLYGLSSSIVSWAVKWEYIVLXFLLLADARICTCLWILLLXCQAEAALENVIVLNAAAAAGXHGFFWGLLVXCXAWHXKGRLVPGATYLCLGXWPLLLLLLLLPQRALALDSSDGGTVGCLVLXILTIFTLTPGYKKXVVLVXWWLQYFIARVEAXIHVWVPPLQVRGGRDAIIMLTCLFHPALGFEVTKILLGILGPLYLLQXSLXKVPYFXRARALLRACLLAKHLVXGKYVQAALLHLGRLTGTYIYDHLAPMKDWAASGLRDLAVATEPIIFSPMETKVITWGADTAACGDILAGLPVSARRGREIFLGPADDIXXAGWRLLAPITAYAQQTRGVLGAIVVSLTGRDKNEAEGEVQVLSTATQTFLGTCINGVMWTVFHGAGXKTLAGPKGPVVQMYTNVDKDLVGWPXPPGXRSLTPCTCGSADLYLVTRHADVIPARRRGDTRASLLSPRPISYLKGSSGGPIMCPSGHVVGVFRAAVCTRGVAKALDFIPVENLETTMRSPVFTDNSTPPAVPHEFQVGHLHAPTGSGKSTKVPAAYAAQGYKVLVLNPSVAATLGFGAYMSRAYGVDPNIRTGVRTVTTGAAITYSTYGKFLADGGCSGGAYDVIICDECHSQDATTILGIGTVLDQAETAGARLVVLATATPPGSVTTPHPNIEEVALPSEGEIPFYGRAIPLXLIKGGRHLIFCHSKKKCDELAKQLTSLGVNAVAYYRGLDVAVIPATGDVVVCSTDALMTGFTGDFDSVIDCNTAVTQTVDFSLDPTFTIETTTVPQDAVSRSQRRGRTGRGRHGIYRYVSSGERPSGIFDSVVLCECYDAGCAWYDLTPAETTVRLRAYLNTPGLPVCQDHLEFWEGVFTGLTNIDAHMLSQTKQGGENFPYLVAYQATVCVRAKAPPPSWDTMWKCMXRLKPTLTGPTPLLYRLGAVQNEITLTHPITKYIMACMSADLEVITSTWVLVGGVVAALAAYCLTVGSVAIVGRIILSGRPAIIPDREVLYQQFDEMEECSASLPYMDEARAIAEQFKEKVLGLIGTAGQKAETLKPAATSMWXKAEQFWAKHMWNFVSGIQYLAGLSTLPGNPAVATLMSFTAAVTSPLTTQQTLLFNILGGWVASQIAPPTAATAFVVSGMAGAAVGSIGLGRVLIDILAGYGAGVAGALVAFKIMCGERPTAEDLVNLLPSILCPGALVVGVICAAVLRRHIGPGEGAVQWMNRLIAFASRGNHVSPTHYVPETDASAKVTQLLSSLTVTSLLKRLHTWIGEDYSTPCDGTWLRAIWDWVCTALTDFKAWLQAKLLPQLPGVPFLSCQRGYKGVWRGDGVNSTKCPCGATISGHVKNGTMRIVGPKLCSNTWHGTFPINATTTGPSVPAPAPNYKFALWRVGAADYAEVRRVGDYHYITGVTQDNLKCPCQVPSPEFFTELDGVRIHRYAPPCNPLLREEVCFSVGLHSYVVGSQLPCEPEPDVTVLTSMLSDPAHITAETAKRRLDRGSPPSLASSSASQLSAPSLKATCTTQGHHPDADLIEANLLWRQCMGGNITRVEAENKVVILDSFEPLKXEEDDREISVSADCFRRGPAFPPALPIWARPGYDPPLLETWKRPDYDPPQVSGCPLPPAGLPPVPPPRRKRKPVELSDSTVSQVLADLADARFKXDTPSIEGQDSAVGTSSQXDSGPEEKRDDXSDAASYSSMPPLEGEPGDPDLSSGSWSTVSDEDSVVCCSMSYSWTGALITPCSAEEEKLPINPLSNTLLRHHNLVYSTSSRSAGLRQKKVTFDRLQVLDDHYREVVDEMKRLASKVKARLLPLEEACGLTPPHSARSKYGYGAKEVRSLDKKALXHIEGVWQDLLDDSDTPLPTTIMAKNEVFAVEPSKGGKKPARLIVYPDLGVRVCEKRALYDXAQKLPTALMGPSYGFQYSPAQRVEFLLKTWKSKKXPMAFSYDTRCFDSTVTEHDIMTEESIYQSCDLQPEARXAIRSLTQRLYCGGPMYNSKGQQCGYRRCRASGVFTTSMGNTMTCYIKALASCRAAKLRDCTLLVCGDDLVAICESQGTHEDEASLRAFTEAMTRYSAPPGDPPVPAYDLELVTSCSSNVSVARDASGNRVYYLTRDPQVPLARAAWETAKHSPVNSWLGNIIMYAPTLWARIVLMTHFFSVLQSQEQLEKALAFEMYGSVYSVTPLDLPAIIQRLHGLSAFSLHSYSPSEINRVASCLRKLGVPPLRAWRHRARAVRAKLIAQGGKAAICGIYLFNWAVKTKRKLTPLADADRLDLSSWFTVGAGGGDIYHSMSRARPRXLLCLLLLXVGVGIFLLPAR

SEQ ID NO: 177 - protein, 3014 aa, Artificial sequence
  Synthetic Sequence
  misc_feature (195)..(195): Xaa can be any naturally occurring amino acid
  misc_feature (237)..(237): Xaa can be any naturally occurring amino acid
  misc_feature (389)..(389): Xaa can be any naturally occurring amino acid
  misc_feature (400)..(400): Xaa can be any naturally occurring amino acid
  misc_feature (403)..(403): Xaa can be any naturally occurring amino acid
  misc_feature (572)..(572): Xaa can be any naturally occurring amino acid
  misc_feature (1877)..(1877): Xaa can be any naturally occurring amino acid
  misc_feature (1944)..(1944): Xaa can be any naturally occurring amino acid
  misc_feature (1967)..(1967): Xaa can be any naturally occurring amino acid
MSTLPKPQRKTKRNTNRRPMDVKFPGGGQIVGGVYLLPRRGPRLGVRATRKTSERSQPRGRRQPIPKARQPTGRHWAQPGYPWPLYGNEGCGWAGWLLSPRGSRPHWGPNDPRRRSRNLGKVIDTLTCGFADLMGYIPVVGAPLGGVAAALAHGVRAIEDGINYATGNLPGCSFSIFLLALLSCLTTPASAVHYXNSSGIYHLTNDCPNSSIVYEADAMILHLPGCVPCVRVGNQSXCWVPVSPTLAVPNASTPATGFRRHVDLLVGAAAFCSALYIGDLCGGVFLVGQLFTFRPRRHQTVQDCNCSIYTGHVTGHRMAWDMMMNWSPTATLVLSSILRVPQLLLDIFLGGHWGVLGAVLYYSMVANWAKVLAVLLLFAGVDATTTTGXAAGRTTSGLTXLFXPGAKQNLQLINTNGSWHINRTALNCNDSLQTGFIAGLFYTHKFNSSGCPERMSSCKPLTDFDQGWGPITYANISGPSEDRPYCWHYAPRPCDVVPARTVCGPVYCFTPSPVVVGTTDRRGLPTYTWGENETDVFLLESLRPPTGGWFGCTWMNSTGFVKTCGAPPCNIXPNSSNNSLLCPTDCFRKHPEATYARCGSGPWLTPRCLVDYPYRLWHYPCTVNFTIHKVRMFVGGVEHRFDAACNWTRGERCELDDRDRIEMSPLLFSTTELAILPCSFTTMPALSTGLIHLHQNIVDVQYLYGVSSSVVSWAVKWEYVVLAFLVLADARICACLWLMLLIGQAEAALENLIVLNAASAASTQGWWWGLLFLCCAWYVKGRLVPACTYALLQLWPLLLLVLALPRRAYAYDNEQAASLGALVLLVITIFTLTPAYKQLLVSFLWWNQYFIARAEAMLHVWVPSLRVRGGRDAVILLTCLLHPQLGFEVTKILLALLGPLYLLQYSLLKVPYFVRAHILLRACLLVRRLAGGKYVQACLLRLGAWTGTYIYDHLAPLSDWASDGLRDLAVAVEPVIFSPMEKKVITWGADTAACGDILAGLPVSARRGNLVLLGPADDMKRGGWRLLAPITAYAQQTRGLLGTIVTSLTGRDKNEVEGEVQVVSTATQSFLATSINGVLWTVYHGAGSKTLAGPKGPVCQMYTNVDQDLVGWPAPPGARSLTPCTCGSSDLYLVTRNADVIPARRRGDTRAALLSPRPISTLKGSSGGPILCPSGHVVGLFRAAVCTRGVAKSLDFVPVENMETTMRSPSFTDNSTPPAVPQTYQVGYLHAPTGSGKSTKVPAAYASQGYKVLVLNPSVAATLGFGSYMSKAHGIDPNIRTGVRTITTGGAITYSTYGKFLADGGCSGGAYDIIICDECHSTDPTTVLGIGTVLDQAETAGVRLTVLATATPPGSVTVPHPNITETALPTTGEIPFYGKAIPLEYIKGGRHLIFCHSKKKCDELAKQLTSLGLNAVAFYRGVDVSVIPTSGDVVVCATDALMTGYTGDFDSVIDCNVAVTQVVDFSLDPTFSIETTTVPQDAVSRSQRRGRTGRGKPGVYRYVSQGERPSGMFDTVVLCEAYDTGCAWYELTPSETTVRLRAYLNTPGLPVCQDHLEFWEGVFTGLTHIDAHFLSQTKQGGENFAYLVAYQATVCARAKAPPPSWDTMWKCLIRLKPMLTGPTPLLYRLGAVQNEITTTHPITKYIMTCMSADLEVITSTWVLVGGVLAALAAYCLSVGCVVICGRITTTGKPAVIPDREVLYQQFDEMEECSRHIPYLAEGQQIAEQFKQKVLGLLQTTAKQAEELKPAVHSAWPKLEQFWQKHLWNFVSGIQYLAGLSTLPGNPAVASLMSFSASLTSPLSTSTTLLLNILGGWVASQLAPPTASTAFVVSGLAGAAVGSIGLGRVLVDILAGYGAGVSGALVAFKIMSGETPAXEDMVNLLPALLSPGALVVGVVCAAILRRHVGPAEGATQWMNRLIAFASRGNHVSPTHYVPETDASRXVTTILSSLTITSLLRRLHEWINXDWSTPCATSWLRDIWDWVCTVLSDFKTWLKAKLVPSLPGIPFLSCQRGFRGVWRGDGVCHTTCTCGAVIAGHVKNGTMKISGPRTCSNTWHGTFPINATTTGPSVPIPEPNYKRALWRVSAEDYVEVVRVGDCHYVVGATADNLKCPCQVPAPEFFTEVDGVRLHRYAPPCKPLLRDEVTFSVGLSSYAIGSQLPCEPEPDVTVVTSMLTDPSHITAETAARRLARGSPPSLASSSASQLSAPSLKATCTTHGDHPDAELIEANLLWRQEMGGNITRVESENKVIVLDSFDPLVAEYDDREISVSAECHRPPRPKFPPALPIWARPDYNPPLLETWKAPDYEPPVVSGCALPPPGPPPIPPPRRKKVVHLDESTVSHALAQLAEKSFPESSSDSTSSDSGLSITSSGSPEPTTDDDACSEAGSYSSMPPLEGEPGDPDLSSGSWSTVSEEDSVVCCSMSYSWTGALITPCAAEEEKLPINPLSNSLIRHHNLVYSTTSRSASLRQKKVTFDRVQVLDQHYQDVLKEIKLRASQVQARLLSTEEACDLTPPHSARSKFGYGAKDVRSHASKAINHINSVWEDLLEDNQTPIPTTIMAKNEVFCVDPSKGGRKPARLIVYPDLGVRVCEKRALYDITRKLPVAVMGDAYGFQYSPKQRVDYLLKMWRSKKTPMGFSYDTRCFDSTVTERDIRTEHDIYQSCQLDPEARKAITSLTERLYVGGPMYNSKGQSCGYRRCRASGVLPTSLGNTLTCYLKAQAACRAAGLKDFDMLVCGDDLVVISESAGVQEDAAALRAFTEAMTRYSAPPGDEPQPTYDLELITSCSSNVSVAHDGTGQRYYYLTRDPTTPLARAAWETARHTPVNSWLGNIIMYAPTIWVRMVLMTHFFQILQSQEQLHKALDFDIYGVTYSITPLDLPAIIQRLHGMAAFSLHGYSPGELNRVAACLRKLGAPPLRAWRHRARAVRAKLIAQGGKAAICGKYLFNWAVKTKLKLTPLRGASKLDLSGWFVAGYSGGDIYHSVSRARPRMLLLCLLLLTVGVGIFLLPAR

SEQ ID NO: 178 - protein, 3013 aa, hepatitis C virus
MSTNPKPQRLTKRNTVRRPQNVKFPGGGQIVGGVYLLPRRGPRLGVRGTRKSSERSQPRGRRQRIPKAASSQGKAWGKPGYPWPLYGNEGCGWAGWLLSPRGSRPTWGPTDPRHRSRNLGKVIDTMTCGFADLMGYIPVLGAPLGGVARALAHGVRVLEDGVNYATGNLPGCSFSIFLLALLSCLTVPASAYEVRNSSGVYHLTNDCPNASIVYETDNAILHEPGCVPCVREGNTSRCWEPVAPTLAVRYRGALTDDLRTHIDLVVASATLCSALYVGDICGAIFIASQAVLWKPGGGRIVQDCNCSIYPGHVTGHRMAWDMMQNWAPALSMVAAYAVRVPGVIITTVAGGHWGVLFGLAYFGMAGNWAKVILIMLLMSGVDAETMAVGARAAHTTGALVSLLNPGPSQRLQLINTNGSWHINRTALNCNDSLQTGFIAALFYTHRFNSSGCPERMASCKPLSDFDQGWGPLWYNSTERPSDQRPYCWHYAPSPCGIVPAKDVCGPVYCFTPSPVVVGTTDRRGVPTYTWGENESDVFLLNSTRPPQGSWFGCSWMNTTGFTKTCGGPPCKIRPQGAQSNTSLTCPTDCFRKHPRATYSACGSGPWLTPRCMVHYPYRLWHYPCTVNFTIHKVRLYIGGVEHRLDAACNWTRGERCDLEDRDRVDMSPLLHSTTELAILPCSFVPLPALSTGLIHLHQNIVDAQYLYGLSPAIISWAIRWEWVVLVFLLLADARICACLWMMMLMAQAEAALENLIHLNAASLAGTHGIWWLLLVFCASWHLRGRVVPLVTYGICGMWPFFLMLLSLPPRAYALDREVSAALGTGMLAIILLVTLGPHYKRLLALILWWVTYFLTRCEAALQTWVPPLNPRGGRDGFILCVLLCYPGLVFDITKWLLVMMCPLYLLQLCLVRTPYFVRAQALIRVCSLFKTLAGGRYVQAALLTIGRWTGTYIYNHLAPLETWAAGGLRDLAVAVEPVIFSPMEKKIIVWGAETTACGDILCGLPVSARLGREVLLGPADDYRSMGWQLLAPISAYAQQTRGLISTLVVSLTGRDKNETAGEVQVLSTSTQTFLGTNVGGVMWGPYHGAGTRTVAGRGGPVLQMYTSVSDDLVGWPAPPGSKSLEPCSCGSADLYLVTRNADVLPLRRKGDGTASLLSPRPVSSLKGSSGGPVLCPQSHCVGIFRAAVCTRGVAKAVQFVPIEKMQVAQRSPSFSDNSTPPAVPSTYQVGYLHAPTGSGKSTKVPAAYASQGYKVLVLNPSVAATLGFGAYMSKAYGIDPSVRTGARTVTTGAPITYSTYGKFLADGGCSGGAYDIIICDECHAIDATTVVGIGTVLDQAETSGVRLVVLATATPPGSVTVPHPNIEEVALGNDGEIPFYGKAIPLQHIKGGRHLIFCHSKKKCDELAGKLTSLGLTAVAYYRGLDVSVIPTSGDVVVVATDALMTGFTGDFDSVIDCNVAVTQTVDFSLDPTFTIETTTVPQDSVSRSQRRGRTGRGRLGIYRYVSSGERPSGMFDTSVLCECYDLGCSWYELTPSETTTRLRAYLNCPGLPVCQDHLEFWEGVFTGLTHIDAHFLSQTKQEGQNYAYLTAYQATVCARAKAPPPSWDVQWKCLQRLKPLLVGPTPLLYRLGSVTNEVTFTHPITKYIATCMAADLEVTTSTWVIVGGVLAAVAAYCMSTGSVVVVGRVVLGSNVVTAPDREVLYQHFDEMEECSKAPELLKHAQTIGGMFKDKALAVLDTLKPAAQAAVPIVETNFQKVEKLWNQHMWNFISGIQYLAGLSTLPGNPTVASLMAFTASVTSPLATSTTLLVNILGGWFASQLAPPSAATTFVVSGLAGAAVGSVGLGKVLVDVLAGYGAGIAGALVAFKIMSGEVPSTEDLANLLPAILSPGALVVGVVCAAIIKRHTGTSEGVTQWMNRLIAFASRGNHVSPTHYIQDDDASKRVMGILSSLTITSLIKRVLAWAQTDYSAPCAGSWLREVWDWVCMVLSDFASWLKAKVLPSLPGIPFLSCQKGYKGEWRNDGIMNTKCPCGALIAGHVKNGSMRIVGPKTCRNTWWGTFPINSHTTGPSSPVPSHCYQRALWRVSATEYVEILRHNDQHYVVGVTAEDLKCPCQVPSPEFFSFVDGVRIHRFAPEPKPMIREEAAFVVGLHSYVVGSQLPCEPEPDVQTVSQLLTDPSHITAETAARRLRRGSPPSNASSSASQLSAPSLKATHTTLPQHPDAELIEANLMWEHKVGAIRRMETDTKVIILDSFDSASSVEDDMEPSTAAECLRTRKVFPPAMPIWARPDYNPPVVENWKDPEYAPPQVSGCALPPAQTPPVPPPRRKRAVIQLTESAVSTALAELAERSFPKEEAPPSDSAISLDSPAANDPPSDCDQGSEISFSSMPPLEGEPGDPDLSDGSWSTVSTRSDVICCSMSYSWTGALVTPSGPEEERLPINALSNTMLRHYNMVYSTTSRSASQRAKKVTFDRLQVLDDHYKRALADVKADASTVKAQLLSVEEAAALTPAHSARSKFGYGAKEVRSLAPKAMSHIKEVWKDLLQDMTTPIPTTIMAKNEVFCVNPAKGGKKPARLIVYPDLGVRVCEKRALYDIAQKLPKAIMGQAYGFQYSPSQRVEYLVKTWKSKRTPMGFSYDTRCFDSTVTEQDIRTESEIYQCCNLDPEARTIINALTERLYVGGPMFNSKGQRVGYRRCRASGVFPTSMGNTMTCYIKAKAAAAAAGLESTDFLVCGDDLVVICESKGVERDRADLQAFAAAMTRYSAPPGDMPQPAYDLEHIDSCSSNVSVARDNSGKRVYYLTRDPTNPLSRAAWETARHSPVNSWVGNIIMFAPTIWVRMVLMTHFFALLLNEERLNDPVSFEMYGATYTVCPTDLPDIIQRLHGLRAFELHTYSPAELTRVAATLRKLGVPPLRTWRQRARKVRAGLIGQGGRARICGLYLFNWAVRTKIKLTPLAGAGRLDLSSWFSVCAGEADVDHSTPRAHPRPLLLCLLLLAVGVGIFLLPAR

SEQ ID NO: 179 - protein, 3008 aa, hepatitis C virus
  misc_feature (1871)..(1871): Xaa can be any naturally occurring amino acid
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSTGLYHVTNDCPNSSIVYEAADAILHTPGCVPCVREGNTSRCWVAMTPTVATRDGKLPTTQLRRHIDLLVGSATLCSALYVGDLCGSVFLVGQMFTFSPRRHWTTQDCNCSLYPGHITGHRMAWDMMMNWSPTAALITAQLLRIPQAILDMIAGAHWGVLAGIAYFSMVGNWAKVLVVLLLFAGVDAQTHVTGGRAAHITAGLTSLFSPGPSQKLQLVNTNGSWHINSTALNCNDSLKTGWIAGLLYSYKFNSSGCPERLASCRRLTDFAQGWGPISHANGSGPDERPYCWHYPPRPCGIVPAKSVCGPVYCFTPSPVVVGTTDKSGAPTYNWGENDWDVFVLNNTRPPLGNWFGCTWMNSTGFTKVCGAPPCVIGGAGNNTLRCPTDCFRKHPDATYSRCGSGPWITPRCLVDYPYRLWHYPCTVNYSIFKIRMYLGGVEHRLEAACNWTRGERCDLEDRDRSELSPLLLSTTQWQVLPCSFTTLPALSTGLIHLHQNIVDVQYLYGVGSSVASWAIKWDYVVLLFLLLADARICSCLWMMLLISQAEAALENLVVLNAASLAGTHGLAPFLVFFCLAWYLKGKWAPGAVYAVYGMWPLLLLLLALPQRAYALDTEVAASCGGAVLVGLMVLTLSPHYKHYISWCLWWLQYFLTRAEAQLHVWVPPLNVRGGRDAVILLMCVVHPTLVFDITKLLLAVGPLWILQTSLLKVPYFVRVQGLLRICALARKIAGGHYVQMAIIKLGALTGTYIYDHLTPLRDWAHNGLRDLAVAVEPVVFSRMETKLITWGADTAACGDIINGLPVSARRGQEILLGPADGMVSKGWRLLAPITAYAQQTRGLLGCIITSLTGRDKNQVEGEVQIVSTAAQTFLATCINGVCWTVYHGAGTRTIASPKGPVIQMYTNVDKDLVGWPAPPGSRSLTPCTCGSSDLYLVTRHADVIPVRRRGDSRGSLLSPRPISYLKGSSGGPLLCPAGHAVGIFRAAVCTRGVAKAVDFIPVESLETTMRSPVFTDNSSPPVVPQSFQVAHLHAPTGSGKSTKVPAAYAAQGYKVLVLNPSVAATLFGAYMSKAHGVDPNIRTGVRTITTGSPITYSTYGKFLADGGCSGGAYDIIICDECHSTDATSILGIGTVLDQAETAGARLVVLATATPPGSVTVPHPNIEEVALSTTGEIPFYGKAIPLEVIKGGRHLIFCHSKKKCDELAAKLVALGINAVAYYRGLDVSVIPTSGDVVVVATDALMTGYTGDFDSVIDCNTCVTQTVDFSLDPTFTIETTTLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENFPYLVAYQATVCARAQAPPPSWDQMWKCLIRLKPTLHGPTPLLYRLGAVQNEVVLTHPITKYIMTCMSADLEVVTSTWVLVGGVLAALAAYCLSTGCVVIVGRVVLSGKPAIIPDREVLYQEFDEMEECSQHLPYIEQGMMLAEQFKQKALGLLQTASRQAEVIAPAVQTNWQKLEAFWAKHMWNFISGIQYLAGLSTLPGTPAIASLMAFTAAVTSPLTTSQTLLFNILGGWVAAQLAAPGAATAFVGAGLAGAAIGSVGLGKVLVDILAGYGAGVAGALVAFKIMSGEXPSTEDLVNLLPAILSPGALVVGVVCAAILRRHVGPGEGAVQWMNRLIAFASRGNHVSPTHYVPESDAAARVTAILSSLTVTQLLRRLHQWISSECTTPCSGSWLRDIWDWICEVLSDFKTWLKAKLMPQLPGIPFVSCQRGYRGVWRGDGIMHTRCHCGAEITGHVKNGTMRIVGPRTCRNMWSGTFPINAYTTGPCTPLPAPNYKFALWRVSAEEYVEIRQVGDFHYVTGMTTDDLKCPCQVPSPEFFTELDGVRLHRFAPPCKPLLREEVSFRVGLHAYPVGSQLPCEPEPDVAVLTSMLTDPSHITAETARRLARGSPPSVASSSASQLSAPSLKATCTANHDSPDAELIEANLLWRQEMGGNITRVESENKVVILDSFDPLVAEEDEREISVPAEILRKSRRFTQALPVWARPDYNPPLVEAWKKPDYEPPVVHGCPLPPPKSPPVPPPRKKRTVVLTESTLSTALAELATKSFGSSSTSGITGDNTTTSSEPAPPGCSPDSDAESCSSMPPLEGEPGDPDLSDGSWSTVSSEADTEDVVCCSMSYTWTGALITPCAAEEQKLPINALSNSLLRHHNLVYSTTSRSACQRQKKVTFDRLQVLDNHYQDVLKEVKAAASKVKANLLSVEEACSLTPPHSAKSKFGYGAKDVRCHARKAVNHINSVWKDLLEDSVTPIDTTIMAKNEVFCVQPEKGGRKPARLIVFPDLGVRVCEKMALYDVVSKLPLAVMGDSYGFQYSPGQRVEFLVQAWKSKKTPMGFSYDTRCFDSTVTESDIRTEEAIYQCCDLDPQARVAIKSLTERLYVGGPLTNSRGENCGYRRCRASGVLTTSCGNTLTCYIKAKAACRAAGLQNCTMLVCGDDLVVICESAGVQEDAASLRAFTEAMTRYSAPPGDPPQPEYDLELITSCSSNVSVAHDGAGKRVYYLTRDPTTPLARAAWETARHTPVNSWLGNIIMFAPTLWARMVLMTHFFSVLIARDQLEQALDCEIYGACYSIEPLDLPPIIQRLHGLSAFSLHSYSPGEINRVAACLRKLGVPPLRTWRHRARSVRAKLLSRGGRAAICGKYLFNWAVRTKLKLTPIAAAGRLDLSGWFTAGYSGGDIYHSVSHARPRWFWFCLLLLAAGVGIYLLPNR

SEQ ID NO: 180 - protein, 3021 aa, hepatitis C virus
MSTLPKPQRKTKRNTIRRPQDVKFPGGGQIVGGVYVLPRRGPRLGVRATRKTSERSQPRERRQPIPKARRSDGRSWAQPGYPWPLYGNEGCGWAGWLLSPRGSRPSWGPNDPRRRSRNLGKVIDTLTCGFADLMGYIPIVGAPVGGVARALAHGVRALEDGINFATGNLPGCSFSIFLLALLSCLIHPAASLEWRNTSGLYILTNDCPNSSIVYEADDVILHTPGCIPCVQDGNTSTCWTSVSPTVAVRYVGATTASIRSHVDLLVGAATLCSALYVGDMCGAVFLVGQAFTFRPRRHQTVQTCNCSLYPGHLTGHRMAWDMMMNWSPAVGMVVAHVLRMPQTVFDIIAGAHWGILAGLAYYSMQGNWAKVAIIMVMFSGVDAETHTTGGTAARNAFTLTGLFTQGARQKLQLINTNGSWHINRTALNCNESLNTGFIAGLFYLHKFNSTGCPERLSSCKPITFFRQGWGSLTDANITGPSDDKPYCWHYAPRPCEVVPALNVCGPVYCFTPSPVVVGTTDRQGVPTYTWGENETDVFLLRSLRPPSGQWFGCTWMNSTGFVKTCGAPPCDIYGGGGNRCNESDLFCPTDCFRKHPEATYSRCGAGPWLTPRCLVDYPYRLWHYPCTVNFTLFKVRMFVGGFEHRFTAACNWTRGERCNIEDRDRSEQHPLLHSTTELAILPCSFTPMPALSTGLIHLHQNIVDVQYLYGVGSGVVGWALRWEFVVLVFLLLADARVCVALWLMLMISQAEAALENLVTLNAVAAAGTHGIGWYLVAFCAAWHLRGKLVPLVTYSLTGLWSLAVLVLLLPQRAYAWSGEDSATLGAGILVLFGFFTLSPWYKHWIGRLMWWNQYTICRCEAALQVWVPPLLARGSRDGAILLTSLLYPSLIFDITKLLIAVLGPLYLIQAAITTTPYFVRAHVLVRLCMLVRSVMGGKYFQMIILSIGRWFNTYLYDHLAPMQHWAAAGLKDLAVATEPVIFSPMEIKVITWGADTAACGDILCGLPVSARLGHEVLLGPADDYREMGWRLLAPITAYAQQTRGLLGTIVTSLTGRDKNVVTGEVQVLSTATQTFLGTTIGGVMWTVYHGAGSRTLAGVKHPALQMYTNVDQDLVGWPAPPGAKSLEPCSCGSTDLYLVTREADVIPARRRGDSTASLLSPRPLACLKGSSGGPVMCPSGHVAGIFRAAVCTRGVAKALQFIPVETLSAQARSPSFSDNSTPPIVPQSYQVGYLHAPTGSGKSTKVPAAYVAQGYNVLVLNPSVAATLGFGSFMSRAYGIDPNIRTGNRTVTTGAKLTYSTYGKFLADGGCSGGAYDVIICDECHAQDATSILGIGTVLDQAETAGVRLTVLATATPPGSITVPHSNIEEVALGSEGEIPFYGKAIPLAQLKGGRHLIFCHSKKKCDEMASKLRGMGLNAVAYYRGLDVSVIPTAGDVVVCATDALMTGFTGDFDSVIDCNVTVEQYVDFSLDPTFSIETRTAPQDAVSRSQRRGRTGRGRLGTYRYVAPGERPSGMFDSVVLCECYDAGCSWYDLQPAETTVRLRAYLSTPGLPVCQDHLDFWESVFTGLTHIDAHFLSQTKQQGLNFSYLTAYQATVCARAQAPPPSWDEMWKCLLRLKPTLHGPTPLLYRLGPVQNETCLTHPVTKYIMACMSADLEVTTSTWVLLGGVLAALAAYCLSVGCVVIVGHIELGGKPALIPDKEVLYQQYDEMEECSQAAPYVEQAQAIAHQFKEKLLGLLQRATQQQAVIEPIVATNWQKLEAFWHKHMWNFVSGIQYLAGLSTLPGNPAVASLMAFTASVTSPLTTNQTMFFNILGGWVATHLAGPQSSSAFVVSGLAGAAIGGIGLGRVLLDILAGYGAGVSGALVAFKIMGGEIPTAEDMVNLLPAILSPGALVVGVICAAILRRHVGPGEGAVQWMNRLIAFASRGNHVSPTHYVPESDAAARVTALLSSLTVTSLLRRLHHWINEDYPSPCSGDWLRTIWDWVCMVLSDFRTWLSAKIMPALPGLPFLSCQKGYKGVWRGDGVVSTRCPCGASITGHVKNGSMRLAGPRTCANMWHGTFPINEYTTGPSTPCPSPNYTRALWRVAANSYVEVRQVGDFHYITGATEDGLKCPCQVPAAEFFTEVDGVRLHRYAPPCKPLLRDEITFMVGLNSYAIGSQLPCEPEPDVSVLTSMLRDPSHITAETAARRLARGSPPSEASSSASQLSAPSLKATCQTHRPHPDAELVDANLLWRQEMGSNITRVESETKVVILDSFEPLRAEADDAELSVAAECFKKPPKYPPALPIWARPDYNPPLLDRWKTPDYVPPTVHGCALPPRGAPPVPPPRRKRTVQLDGSNVSAALAALAEKSFPSLEPQGENSSSSGIDIQSSTASEVPPSPEGESDSESCTSMPPLEGEPGDPDLSCDSWSTVSDSEEQSVVCCSMSYSWTGALITPCSAEEEKLPISPLSNSLLRHHNLVYSTSSRSASQRQKKVTFDRLQVLDDHYKAVLKEVKERASRVKARMLTIEEACALVPPHSARSKFGYSAKDVRSLSGRAVNQIRSVWEDLLEDTTTPIPTTIMAKNEVFCVDPSKGGRKPARLIVYPDLGVRVCEKRALYDVIQKLSIATMGSAYGFQYSPQQRVERLLEMWTSKKTPMGFSYDTRCFDSTVTEQDIRVEEEIYQCCNLEPEARKVISSLTERLYCGGPMFNSKGAQCGYRRCRASGVLPTSFGNTITCYIKATAAARAAGLRNPDFLVCGDDLVLVAESDGVDEDRAALRAFTEAMTRYSAPPGDAPQPTYDLELITSCSSNVSVARDNKGKRYYYLTRDATTPLARAAWETARHTPVNSWLGNIIMYAPTIWVRMVMMTHFFSILQSQEILDRPLDFEMYGATYSVTPLDLPAIIERLHGLSAFTLHSYSPVELNRVAGTLRKLGCPPLRAWRHRARAVRAKLIAQGGKAKICGLYLFNWAVRTKTNLTPLPAAGQLDLSSWFTVGVGGNDIYHSVSRARTRHLLLCLLLLTVGVGIFLLPAR

What is claimed is:

1. An immunogenic composition comprising as separate entities:

a) a hepatitis C virus (HCV) E1/E2 heterodimeric polypeptide comprising:

i) an HCV E1 polypeptide; and ii) an HCV E2 polypeptide;

b) a T-cell epitope polypeptide comprising a T-cell epitope present in an HCV protein other than E1 and E2; and c) a pharmaceutically acceptable carrier.

2. The immunogenic composition of claim 1, wherein the T-cell epitope polypeptide comprises one or more T cell epitopes present in one or more of:

a) an HCV non-structural polypeptide-3 (NS3) polypeptide;

b) an HCV non-structural polypeptide-2 (NS2) polypeptide;

c) an HCV non-structural polypeptide-4A (NS4A) polypeptide;

d) an HCV non-structural polypeptide-4B (NS4B) polypeptide;

e) an HCV non-structural polypeptide-5A (NS5A) polypeptide;

f) an HCV non-structural polypeptide-5B (NS5B) polypeptide;

g) an HCV core polypeptide; and h) an HCV p7 polypeptide.

3. The immunogenic composition of claim 1, wherein:

a) the HCV E2 polypeptide is derived from an HCV of major genotype 1, 2, 3, 4, 5, 6, or 7; and b) the HCV E1 polypeptide is derived from an HCV of major genotype 1, 2, 3, 4, 5, 6, or 7.

4. The immunogenic composition of claim 1, wherein the T-cell epitope polypeptide has a length of from about 10 amino acids to about 3000 amino acids.

5. The immunogenic composition of claim 1, wherein the T-cell epitope polypeptide comprises one or more T cell epitopes present in an HCV NS3 polypeptide.

6. The immunogenic composition of claim 5, wherein the T-cell epitope polypeptide comprises an amino acid sequence having at least 20% amino acid sequence identity to the amino acid sequence of one of a TP29 polypeptide comprising the amino acid sequence set forth in SEQ ID NO:94, a TP50 polypeptide comprising the amino acid sequence set forth in SEQ ID NO:99, a TP52 polypeptide comprising the amino acid sequence set forth in SEQ ID NO:95, a TP70 polypeptide comprising the amino acid sequence set forth in SEQ ID NO:96, a TP100 polypeptide comprising the amino acid sequence set forth in SEQ ID NO:97, a TP171 polypeptide comprising the amino acid sequence set forth in SEQ ID NO:89, a TP228 polypeptide comprising the amino acid sequence set forth in SEQ ID NO:81, a TP553 polypeptide comprising the amino acid sequence set forth in SEQ ID NO:100, a TP778 polypeptide comprising the amino acid sequence set forth in SEQ ID NO:101, and a TP1985 polypeptide comprising the amino acid sequence set forth in SEQ ID NO:102.

7. The immunogenic composition of claim 1, wherein the T-cell epitope polypeptide comprises one or more T cell epitopes present in:

a) cholera toxin or toxoid; and/or b) tetanus toxin or toxoid; and/or c) diphtheria toxin or toxoid; and/or d) CRM197.

8. The immunogenic composition of claim 1, wherein the composition comprises a polypeptide comprising one or more T cell epitopes present in:

a) cholera toxin or toxoid; and/or b) tetanus toxin or toxoid; and/or c) diphtheria toxin or toxoid; and/or d) CRM197.

9. The immunogenic composition of claim 1, wherein the E2 polypeptide and/or the E1 polypeptide lacks a C-terminal transmembrane domain.

10. The immunogenic composition of claim 1, wherein the HCV E1/E2 heterodimeric polypeptide comprises:

a) an HCV E1 polypeptide; and b) a modified E2 polypeptide comprising, in order from N-terminus to C-terminus:

i) from 1 to 6 heterologous amino acids, wherein the from 1 to 6 heterologous amino acids are C-terminal to a site of proteolytic cleavage in a proteolytically cleavable linker; and ii) an HCV E2 polypeptide; or a) an HCV E2 polypeptide; and b) a modified E1 polypeptide comprising, in order from N-terminus to C-terminus:

i) from 1 to 6 heterologous amino acids, wherein the from 1 to 6 heterologous amino acids are C-terminal to a site of proteolytic cleavage in a proteolytically cleavable linker; and ii) an HCV E1 polypeptide; or a) an HCV E1 polypeptide; and b) a modified E2 polypeptide comprising, in order from N-terminus to C-terminus:

i) an HCV E2 polypeptide; and
ii) from 1 to 6 heterologous amino acids, wherein the from 1 to 6 heterologous amino acids are N-terminal to a site of proteolytic cleavage in a proteolytically cleavable linker; or
a) an HCV E2 polypeptide; and
b) a modified E1 polypeptide comprising, in order from N-terminus to C-terminus:
i) an HCV E1 polypeptide; and
ii) from 1 to 6 heterologous amino acids, wherein the from 1 to 6 heterologous amino acids are N-terminal to a site of proteolytic cleavage in a proteolytically cleavable linker.

11. The immunogenic composition of claim 10, wherein:
a) the from 1 to 6 heterologous amino acids at the N-terminus of the modified E2 polypeptide or the modified E1 polypeptide are Gly-Pro, Ser, Gly, or Gly-Ser; or
b) the from 1 to 6 heterologous amino acids at the C-terminus of the modified E2 polypeptide or the modified E1 polypeptide are LEVLFQ as set forth in SEQ ID NO:76, ENLYYFQ as set forth in SEQ ID NO:83, LVPR as set forth in SEQ ID NO:78, I(E/D)GR as set forth in SEQ ID NO:90, or DDDDK as set forth in SEQ ID NO:77.

12. The immunogenic composition of claim 1, comprising an adjuvant.

13. The immunogenic composition of claim 12, wherein the adjuvant comprises MF59; alum; poly(DL-lactide co-glycolide); a CpG oligonucleotide; keyhole limpet hemocyanin; or a suspension of liposomes comprising 3'-O-desacyl-4'-monophosphoryl lipid A (MPL) and *Quillaja saponaria* 21 (QS21); AS01; or a mixture of alum and MPL.

14. A method of inducing an immune response in an individual to a hepatitis C virus (HCV) polypeptide, the method comprising administering to the individual:
a) an effective amount of the immunogenic composition of claim 1; or
b) one or more nucleic acids comprising nucleotide sequences encoding the HCV E1/E2 heterodimeric polypeptide and the T-cell epitope polypeptide of claim 1.

15. An immunogenic composition comprising:
a1) a hepatitis C virus (HCV) heterodimeric polypeptide comprising:
i) an HCV E1 polypeptide; and
ii) a modified HCV E2 polypeptide comprising a heterologous Gly-Pro, Gly-Ser, Gly, or Ser appended to the N-terminus of an HCV E2 polypeptide;
b1) a T-cell epitope polypeptide comprising an amino acid sequence having at least 95% amino acid sequence identity to a TP29 polypeptide comprising the amino acid sequence set forth in SEQ ID NO:94 and having a length of 29 amino acids; and
c1) a pharmaceutically acceptable carrier; or
a2) a hepatitis C virus (HCV) heterodimeric polypeptide comprising:
i) an HCV E1 polypeptide; and
ii) a modified HCV E2 polypeptide comprising a heterologous Gly-Pro, Gly-Ser, Gly, or Ser appended to the N-terminus of an HCV E2 polypeptide;
b2) a T-cell epitope polypeptide comprising an amino acid sequence having at least 95% amino acid sequence identity to a TP50 polypeptide comprising the amino acid sequence set forth in SEQ ID NO:99 and having a length of 50 amino acids; and
c2) a pharmaceutically acceptable carrier; or
a3) a hepatitis C virus (HCV) heterodimeric polypeptide comprising:
i) an HCV E1 polypeptide; and
ii) a modified HCV E2 polypeptide comprising a heterologous Gly-Pro, Gly-Ser, Gly, or Ser appended to the N-terminus of an HCV E2 polypeptide;
b3) a T-cell epitope polypeptide comprising an amino acid sequence having at least 95% amino acid sequence identity to a TP52 polypeptide comprising the amino acid sequence set forth in SEQ ID NO:95 and having a length of 52 amino acids; and
c3) a pharmaceutically acceptable carrier; or
a4) a hepatitis C virus (HCV) heterodimeric polypeptide comprising:
i) an HCV E1 polypeptide; and
ii) a modified HCV E2 polypeptide comprising a heterologous Gly-Pro, Gly-Ser, Gly, or Ser appended to the N-terminus of an HCV E2 polypeptide;
b4) a T-cell epitope polypeptide comprising an amino acid sequence having at least 95% amino acid sequence identity to a TP70 polypeptide comprising the amino acid sequence set forth in SEQ ID NO:96 and having a length of 70 amino acids; and
c4) a pharmaceutically acceptable carrier; or
a5) a hepatitis C virus (HCV) heterodimeric polypeptide comprising:
i) an HCV E1 polypeptide; and
ii) a modified HCV E2 polypeptide comprising a heterologous Gly-Pro, Gly-Ser, Gly, or Ser appended to the N-terminus of an HCV E2 polypeptide;
b5) a T-cell epitope polypeptide comprising an amino acid sequence having at least 95% amino acid sequence identity to a TP100 polypeptide comprising the amino acid sequence set forth in SEQ ID NO:97 and having a length of 100 amino acids; and
c5) a pharmaceutically acceptable carrier; or
a6) a hepatitis C virus (HCV) heterodimeric polypeptide comprising:
i) an HCV E1 polypeptide; and
ii) a modified HCV E2 polypeptide comprising a heterologous Gly-Pro, Gly-Ser, Gly, or Ser appended to the N-terminus of an HCV E2 polypeptide;
b6) a T-cell epitope polypeptide comprising an amino acid sequence having at least 95% amino acid sequence identity to a TP171 polypeptide comprising the amino acid sequence set forth in SEQ ID NO:89 and having a length of 171 amino acids; and
c6) a pharmaceutically acceptable carrier; or
a7) a hepatitis C virus (HCV) heterodimeric polypeptide comprising:
i) an HCV E1 polypeptide; and
ii) a modified HCV E2 polypeptide comprising a heterologous Gly-Pro, Gly-Ser, Gly, or Ser appended to the N-terminus of an HCV E2 polypeptide;
b7) a T-cell epitope polypeptide comprising an amino acid sequence having at least 95% amino acid sequence identity to a TP228 polypeptide comprising the amino acid sequence set forth in SEQ ID NO:81 and having a length of 228 amino acids; and
c7) a pharmaceutically acceptable carrier; or
a8) a hepatitis C virus (HCV) heterodimeric polypeptide comprising:
i) an HCV E1 polypeptide; and
ii) a modified HCV E2 polypeptide comprising a heterologous Gly-Pro, Gly-Ser, Gly, or Ser appended to the N-terminus of an HCV E2 polypeptide;

b8) a T-cell epitope polypeptide comprising an amino acid sequence having at least 95% amino acid sequence identity to a TP553 polypeptide comprising the amino acid sequence set forth in SEQ ID NO:100 and having a length of 553 amino acids; and c8) a pharmaceutically acceptable carrier; or a9) a hepatitis C virus (HCV) heterodimeric polypeptide comprising:

i) an HCV E1 polypeptide; and ii) a modified HCV E2 polypeptide comprising a heterologous Gly-Pro, Gly-Ser, Gly, or Ser appended to the N-terminus of an HCV E2 polypeptide;

b99) a T-cell epitope polypeptide comprising an amino acid sequence having at least 95% amino acid sequence identity to a TP778 polypeptide comprising the amino acid sequence set forth in SEQ ID NO:101 and having a length of 778 amino acids; and c) a pharmaceutically acceptable carrier; or a10) a hepatitis C virus (HCV) heterodimeric polypeptide comprising:

i) an HCV E1 polypeptide; and ii) a modified HCV E2 polypeptide comprising a heterologous Gly-Pro, Gly-Ser, Gly, or Ser appended to the N-terminus of an HCV E2 polypeptide;

b10) a T-cell epitope polypeptide comprising an amino acid sequence having at least 95% amino acid sequence identity to a TP1985 polypeptide comprising the amino acid sequence set forth in SEQ ID NO:102 and having a length of 1985 amino acids; and c10) a pharmaceutically acceptable carrier.

16. The immunogenic composition of claim 15, comprising an adjuvant.

* * * * *